United States Patent 9,976,180 (METHODS FOR DETECTING A GENETIC VARIATION IN SUBJECTS WITH PARKINSONISM) - sequence listing, part 30

SEQ ID NO: 442 - DNA, 500431 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttccctagcaacgggaggagaaaggcagctcagacacacgcgtgccccggcgccctcccggaacgtgccccggcccggtggcgtggcaggagctcggcatcttcccgtggctccgtcagcagccaaaaggagaagcgtccatcggaaaaatggcatattacaaattttgctttgggaagcaaagctcggttc

SEQ ID NO: 443 - DNA, 500431 bp, Homo sapiens; identical to SEQ ID NO: 442

SEQ ID NO: 444 - DNA, 500243 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttcc

SEQ ID NO: 445 - DNA, 500243 bp, Homo sapiens; identical to SEQ ID NO: 444

SEQ ID NO: 446 - DNA, 499754 bp, Homo sapiens
gaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctcagtgataatcacctccctccaccacagtctagcagagtgattatgctaaatatcctggttaaccaataacatacagtttcatttcagggaagcatgcacagtgtattcagaggacctcttctgactaacctgaagcatgtttcatatactgtttaaagctctacttagtaacaaattgctgttttatcactcttatttctgtatctttctaaatcttttagtcactcccagacttttcaacaagatgtgattttttttttacaaagcctttttttttttaaagggagttcttttataatttatagatcaaagtatattacagctgttacagctggcccggatattgagaggcaattgcatacaattcagtaagactgtatatactaggagtactatcaaataaaatgtaccaaatattttccacttttctgaactgctatagaatgtcatgaatacgaatgaaattattattatctcatttccccatcttagctaaaaaatcattatgtttgacaatcagtgcttcaaaaagtaccacatatttgttttaaataatcacaaccttatttcatatacatatatacacacaagaattaataaaaatatttaatacacatgaagattttcaactcaaaaatccaaaaatattgaatgcaaacatgtaggttttgttgcaaaatatgttctttttgtatatctttaacaaattcttcaatttgtacaaaagatcatattcagatgacttgacaacttttagaggtaaaaataaatgttccatttacacatcgttcaaatgtggagacttcagtaggataggaaacagaataagccaaaagtggtgtctttgtgaatgtatctaagatgacatagtcatacataataaaaaccacctactttaaacctgaaggctgtaaaggatgatgatttacacatacaacctaaattattattcattagtatttctgattctccaattatgcatgaagtttataacatcaatggaaaggatgcagaaaagtgatcctcaattctttagatgggactcctacattctgataaattaagtgtgtaggtaattatttaactagcaaactgctaaataaaccagaaaattattttaataaaatcttaatttgggaataatttctgatttatagaaaatctgcaaagaaagtacagagaattcctgtatgtccttcattcagtttttctaactgttatcttacattaactatgggacacttgtcaaaactaagaaactgatgttagtgtattattattaactaaactcaatactttacttggattttactagtattgacattaatgtgctctttgtattttaggttcaaattcaggataccatatttacttagttgtcatgtctctccagtttcttttggtgtgtgacagcttttctttgtttctcatgaccttgatggtctggagaggaactggccaaatgtaccatagaatatcccctaatcccatgaaatcatacatgtttgcctgttttcatcctgattacactgggctatgaatggataagcataccacaaaggtgaagtgtcctcaatcacatcatattagtggtacatgacatccagataacattattaatgatgtcaacctttgtcatttgacaaacaaagtttttgcctggtttctctactataaagttactattttccctttcccatactctattatttggaaagtagtacaccctcaacagggttggtaagaaatggcggaaattaagcttggccccttggaagacagagtacctacatatattaaatagatttcttctgtaatggctggcctcttttccttcaattatttactttttcagttatttacttacaacagtatagactcatgtatacttactttacactctggtttgaaatttaatattacataatttaatatgtttttcatattgtcccagctttaatcattggtagctcctttatttcaggttgtctcctgtgtcccttgacatgctcccatccttttgtttttagagcactcaatgattatttttttaaaatggttttctcttgcataaatcgcttatgatttgctgaaactatttatttccttaactataactctaattattattgtgagtaaacttgaaaatttatgttttattttccagtaatttttaagcagctatattattcaattttttcaaattaatatttttcccttctgatatcttagtccacatgggatttattcaaatgataatcaaattttttaaatgactaaatagatttactagctgtggaaataagttatatatgtgaaatattctagatacgtgttaggatcttacttcctcttatggttagcgaggccatgtaactcatgttccccacagagttgtgagtagaaataatccctcaaacagaaacctcaaggtttaagagcgaagttttaagaaaaaagaatgtttgtcaaatagatttttaccatgcaaatataaactccatgtacttttatgtttgcctgtaaactgggtctaacacaattgagatcagaaaattcaccagatcccttgttattgtagaggaactcataaatcaaatgtttttggtaaaatatcacatattcttaatataatctcatgtatttgctgcatttgcatcagccagaaaactattttattttagctgggaattatgaatctttccagccaataagaatacactttctttttcatatttctttggtgggggaggagatgaaaatagtatagattaatgttaaaagaggcaggagggagaaatagtactactaatatataattattttaagtacaatgctttattctaaatgttactgaaattgccaaagtatacaatttttccagaacattttttcctatgattattttgataataatgttatctcgtaattctgaatgtctatttggaaacaactcaattttctcttctgcctggtagcaataggaaaggtgttgtccaggtctaaaaattgccaagatttagaattattcattgtccattgtggttgaggccaaagcttatatatcaaggtacggtcccatcattctcattctgaaaagccatgagagttggagttgctggaggatggaaaagtttctgtctcactaaaaaacacatccctttaactcatgttaactgcctaaaggaaataataagtattaaatttagtcagggacatttgacactttttttttttctgtagggaagccccattcagtcaggcccaagaagtcctaatgggcaggaactgaacagtcttggagcaggctcagagttgtgctaagttccatgcccaacatttcatctagtactgtactttccaaacctggtttgtttgtacccttaggtacatacagtttgaaaaactatgaagcctctctttgtcaaaatttaaatattttaagagatttaaattacagtacctcataggtattgacagatgatactcatttaaatgaatcaaatggaataaagatgatctagcaatttaatgcccatcttctattaaaaacctcaagagctcttaaaaattgaaattttataccatcccttttattccttcaacttttttccttttctcctgcacataattttattttactatattgtactatctttctatattgtgtgccttaaagtattttatcagtaatattatattttgttgctgcaaaaatatataatatacacttaaaatatttttctttttaaattttaaatgactatatggttgtaagtgttaaaacttgtctcttgaaatgagcagcattcacaaatattattaccacacaatgtaccagaacagaataaatatattaaaatgctgataaacagagaaaatacaatattatgtctggataacacaaaaaatgtatgtttgtataatacaactgcagttttatcttttttaaactagcttatgtttcaattcaaacatcctattagaattagacagagtcctaattttcagttttgtagatttattgttgagaaactctgttcccagaagtaagtagatggaaaagaaaaaaggttgtgttgttgttatggtttttatcagcaatattactcaaattttctgatttcttctgcatatatactagaataaagatatattttataataatcattaaataccttgattaaatcaacctccgattttgttgaaagctaacaaccagaaaacatctggctttcaaaaaggatttcttatgtagctattaaagtcattcactttcctaacacctaaatctataatttgagtggtttcttattttggtccttgaagttttgagaccctggagtaatgcgacacagttaagattcatgagaaacatacactctgaaagagaagattgatttaaatgcagacagaactccttaattgcggcactgttctcagaataataaattttagaaaagggtacatatagaagaagaaaatgaatcccttgcaaatatccatgtccttgtatttcttggacagtcttcataccttaattttaaataactatcaaacatctatccctgcaatcaaatacgtttccggtggttgataaatgttgactcaatgaatgtgctgcttacacaatatggctaagtaattgctttaaacatcatttctaatcaatataatcaaaaattaaaaatcagcctggtcatagtcttattagaaattcaaaacttcagcatatgctcagaatgtagaggaaaaaattcagtgaccacgctgagttcattgttccttaataagcctcaatctcctcacttatgaaatggggagaatattgcctcactcaaagtcttctgtaacatttaaataaaattaagatagtaagaccctaatttgtctccattctctgcaatgtcttgcattaattgcaatgtctcattaattgcatatagtagataatttatagtgtaactggcacatatttgaggggaaaagaagaacgatcaatcattatttcagacaatagacacgaagactgttcttggtaaaccagaacttggtcttgtgtttaccatggcctttgtactcatggtaaacacaaaagtatgtttacatttgaggagcttttattatattggaggaaaaaaaaacagatacactttttgaaaaattactttaagagcattatatatatcaaatccattctaaagaatataaacaaatgtggacattaatttaggcttattaattagggtgacttcatgggctacattacctgaaaatctagaaaggaagaaagaactaacattcagtacttgtgtgtcagacatggacacatggcatttaatttgagccatacactgtcatttggcctgggtaatatattgattttacatatgagaacattgatatttaagaaagtagaatacctttttcaaggacagaatcactattctgactaaaaaaaaaaaaaaaaaaaaagccctgtccattacacctgtcccttactgttttcctttctcttccacatttattcgtttatttatttattcaactatgcattaatcaaagactaattaccaaatgccttaaatttgcctggtattgtttccaggctttggggacaggattatcagatacaatatcagtgctttaggaactttaaattttgtgggagagataccagctaaggagaggtagttaagtagcaaaacaactgcaatgtagtttgacaaatgctaaccattgacttgatgtaatgtatactgagttcatctggaaatcactgatttccagtgggtgatttccagtgggtgaccatggcaaaagcaggaggttaaaggatttccaaaaagagaatcaatgtttgaaacaaaatgaaatggcatggaaatggttgggaaaatatggctgaaagcatttcaggacataagaggtaactgtgctaggtgtgtatttgtatttacaaacagttttttcaagtaaaattagtaaagacacttaatctggtcatcatccttttcctataaaatcaaataaaattagaacattcctgtttggaaaaaaaaaagatatgaaatgttgagtcacattttcacacttttggttagtatattttaacatctttctttagtttgccaaatagctttccaagattatttttggttgtgaagaaacttcattcttagtttgattgctttcaatttatcataaaactatttcaatcgaaaattatatatatatattacaatatcacacctcaaataaaatttaatgtgcttatgttatcaatcattggttttcaggcaatggctaccactttacgtgaagggtaaataacatacccattttaatcgctacagacagaccactaccaaaaatttcttaagatgtatcttttccaagagaggtaaattatgaagttgagcttcaggaaatttaatattagctatcacaaccacctcaatttttacagaaaggaattgaaaatgaaacagtaaaagtatgactaaactatacttaacttaaaacggagtaaattaaaaatcctgaagccagacatttgctcttaatagaattaagagaagaccccaagaaattatctaatacacccttgtgcccttaggaacaattactcctatgccatctgaaatgcatgttatcagcttggtgttaatcaatgttccaaaaatacttagagcctatgcttttatatcaggaaattcaactcacatatttttataatcctggaaaataattttgttttaagaaatagttgtgagatatattctgttttaagaccagcaatttgacatagcctttctttcattcatttgtgggtaaagctcaaaattttgctaaaatgataagaatttggggatttaaatacactgaaaaggctgcttattttatgttaatttttgataaatggtcaggggaaaatggtcatactgaaagaacaatggggtgaagaaggaagagaagaacatagtggtgaaagagagagacagatgaaagtaggtaaatgggaaagatgaaggtgagagagaaaagggagaggagagaggaggcgaggggaggaaacagatattacactttgcatggtagcattacacgataacaaagcattttccaagcaaacattcagttaaaattcatgccatatggaatgaaatttgcagcccagatggacaatacatcctagtaaatttatatggataacatatgaacgctagttaagtatgtaatatcactagcctgtctgtctatccatccatccatccagctatctatctatctatctatctatctatctatctatctatctaatctgtctataatttctctatctctatttaatctatcttcatatttatccacttctaacagtatccatacccttagctttatatcatgagttctacaatatgtagcaaaaatgaccctttacagatagccaaaatcctgagtttactctatgatttattttctcaacttttattcagattcagggggtacatgtgcagatttgttacataagtgtattgcacccaggtagtgagcataatagccaataagtagtttttcaacccacgctacactccatcccttcccaccatagtagtctacagtgtcaattgctcctatgttgacgtccctctgtactcaatgcttagcttccacttgtaagtgagaaaatgcagtatttggttttctgtttgtgtgctaattcacttaagattatggcctccagctccatctatgtttctgcaaaggacaagattaattatttttatatggctgcatagtattctacagtgtatatggagcacattttcgctatccagtccaccattgatgggcacccaggttgattccatgtctttgccattgtgaatagaatgacactgaacatatgagtccatgtaactttttggtataatgattgattttcctttgagtatatacccagtaatgggatggctaggttgaattgtagctctgttttaagttatttgaaatatctccaaactgctttttacagtggctgaactcatttacattcccaccaatagtgtataagtgttctctttatccacagcatcaccagcatctattgtttcctggctttgtagtaatagcgattttgcctggtgtgagatagtatctcattgtggttttcatttgcaattctctgatgcttagtgatgttcagtattttttatgtttgctggccacttgaatgtcttcctttgaaaagtatctgttcatttcctttgcccatttttaatgaggttatttgttttttgcttgttgatttaagttccttaaagattctgtatattagacctctgtcagacacatagttcacaaatatttcctcccattctgtaggtcatctgtttactttgttgatagtttatttcactgtgcagaagctctttagtttaattaggtaccatttgtccatttttgcttttgttgtagttgcttttggggacttggcaaaaaaatatttgccaatgccgatgttgagaatggtatttcttcagttttattttaggatttctatagtttgatgtcttacatttaaacctttaatccatctctagttaatttttatataaggtgggaggtaggggcccagtttcaatcttctacatgtggctagcccgttatcccagcaccattaattgaatagggagtcacctcctcatggcttgctattgtcagcctcatcgaagatctgatggttgtaggtggtatctttatttctgagttttctattctgttctattggtttatgtgtccctgtaccaataccatgctgttttggttactggaggcttatagtttgaagtagagcagtgtgatgcctccaactttgttcttttgcttaggattgctttggctatttgggctcttttttggttccatatgaattttagaatagttttctctaattctgtgaagaatgacattgttagtttgatagaagtagttgaatctgtaaattgcttcaggtgtatggacattttaatgatattggtcctacaatccatgagaatggaatgttttttccatttatttgtgtcatctctgatttatttcagcagttttgcagttcctcttgtacagaactttcaactctgtggttagctgaattcctacatatttcattttctttgtggctactgtaaatggaattgtgttctgaattgacttttagcctaaacattattgatgtatagaattgctactgattttttaacattgattttgtatcctgaaactgtgttaaagtcacttatcatttctagtagccttttggcagagtctttagagttttctaagtacagaaccatatcatcagtgaagagagatattttgactttttttcatatttggatgccttttatttctttctcttatttgaatgctctggctaagacttctcgtattatgtcaaataggcgtggtgagaatggacatctttgtctggttccatttctcaagggggacggttctagtttttgctcattcagtatgatgttggttgtgtgtttgttaaagatggctcttcttattttgaggtatattcctttgatgcctagtctgttgggggtttttatcatgaagagatgttgaattttatcacaagttttttctgtgtctattgagatgatcacattgtttttgcttttaattctgcttatgtgatgaatcacatttactcatttacatattttgaaccaaccttgcatcccaggaatcaagcccacttgattgtggtgaattagttttttgatgtgctgttgaattctgttttatagtattctgttgaggatttttgcaactatgatcataagggatactggcctgtagttttatttctttgttgtgtctctgtcagattttggtattaggctgattctggcttcatagaatgagttagggaggagtccctccacttcaattttttggaatagtttcagtaggattggtaccagttcttctttatagatctggtaaaattcagctgtgaatccatctggtccagggcttttttgattggtaggtttcttattactgattgaacttcagaacttgttatgggtcttttcagggtttcaatctctgcctgattcaatcttgggaaattgtatgtttccaagcatttatctatttcttctagattttaaaatttgtgtgcatagagttgcttgtaatactctccgagaatcctttgtgtttctgtgggatcagttgtaatgtcatctttatcatttctgactgtacttatttggatcttctattttttttctttgctaatatagctagtagtatgtcaaccttgcttattttttcaaaaaacaagtcttggtttcatcaatttttaaaatatatttttgcatgtcaattttattgttctctaattttagttatttctttatgtctgctagttttggggttggtttcttctttttatttttcctaggtcctttcagtgcaaagttagagtgctaatttgaactctttctaactttttaatgaaggtatttagggctatagacttccctcttaacattgcttcagttgtatcctagagatttggataagttttatacctattttcattaatttcaaagaattttttttattttaatgttcacccagggattattcaggagtaaattgtttaattttcatgtatttgtatactatagattttttttgctatcaatttctatttttattgcactgtgatccaagaatgtagttggtatgattttaatttttttaatttattgagatttctgttatgagtaagcatgtcatcaatcttaaaatatgttctgtgtgcagatgagaataatgtatattctgtggttgttgggtggagtgttctatagatgtctactaggaccaattggtcaaatgttgagtttaagtccacagtttctttgttgttttgctgctttgacaatctaaggctgtcagtggggcgttgaagtctcccatcattactgtgtgattgtctaagtcttctcataggccaagaagaacttgttttattaaactgggtgctccaatgttgggtatgtatacatttagaatggttaagtctccttgttcaactgtactcattaatattatgcaatgcccttcattgtccttcttaatttttattggtgaaaagtctgtttcatctgatatagaaatagggacgctttctcttttttgttttccatttgcatggtagatctttccttattcttttactttgaacctgtgggtgttgttacatgtgaaatgggtccctggaagaaagcagaaggttgaatcttgtattttacacagtttgccactctgtgtcctttcagtggaacatttaccccatttacattcaaggttaatattgatatgtgtgatttttgatcctgtcattatgttgctagctggttgctatgtagatttgattttacagttgctttatagtacctgagggctatgcacttaaatgtgtttttgtggtagcaggttttgttcttttgattctaagtttagcactcctttatggatcccttgtaaaactagtctagttgaaaacaaatccctcaatatttgcttgtctgagaaggattttatttctccttcaattatgaagcttagtttggtgggatttaaaattcttggttgattttttaaggacactgataacagtctccctatctcttccggcaagtaggatttctgctaagaggtcttttgctagtctgataaagttacttttgtacctgacttgacctttatctctagctgcctttaagatttttttgttaaaaaaatctacatgccttggggacgatcaacttatctagctggggttatctgtatctcttagattttcatgtcaacctctctagtgagattaggagaattttcatggactacatttgcaaatatattttccaaattgtttattttctttctttctctgtcaggatgccaatgaatcatagatttattctctttacataatcccatatttcatagaggttttgttcatttttcccaattcctttttgacttagttgcttcaaaaactggtctttaagctctgagattctttcctcagcttggtctgttctgctgttaatacttcaaattatactatgaaattcttgtagtgagttttccagctttagaagttcagtttggttctttcttaaaatggctatttcatatttcaaatcttggatcattttactagattccctggattttttggatgggtttactttatcctgaatcttgatgagattcttgccgtccagattctgaattctatgtttgtcatttcagtcatttcagactggctaagaaccattgctgaggagctagtggacttgttagaaggggatactgtctttttgaattgtcaagagttccggaactgattctttctcatcagagagttttgatgttcctttaactgtagtataagttgagtatagtcagttgctttgtttctggatgctttcagagcaccagggctttgtgcaggatttttgttgtgggtgaattcttgggcttgttttcacaggtgtatatattaataggataattgttgatgctgtagtttggactgtgatcctgtagatggcacttaagagtaatggctggcagctaggctgatacctagtccctgactcttctacttcctagcattcgcggggaggaataaagatggctcgctcaccatgtctgctctcgggccttgtggggagccctctacagtcaccagcgctgtgcctcggtttcttttggtaggggttccaggccacgagcctctcttgggcaaaggttgtgacagggagatatgccgcaccgtttatgaaccagctcttcagagggaggcatactccactcctacctggggcccgggacccagcaactggcccctctcagtgttctgagctggggtttcctctcctgcaaggggggttcctcccctgcctgagtgctggccgcagcactgagctcttcactgcagccctggggaaccaggacatccgtggttcatggttgggttctagctgtgccagggtgtctgttgtgttcctgtgctgtctggaaagtactcatatacagcaacacattcagcagggccgtggaggctgtggggtgcacccactcctgcagggcagctaggcacaggccctgcgggggtcaggggacagcatgtggaagggtttgcagaacagatgtgccccggtcacatctgttgcaaagaaagttcagctctcttctggctcagaagtcagctggggccaatgcctctgggggagtggggaggcgggcccaagtgatgggcgtttatggctgcttttcactagagctgccagcacacaaaaactcctgggctccatgccgtctcaaggcctgtctctgcctattccctggagagatctcctgacatctcacatgtccataggggatgcagggtcccctgtcactaagttcccagaggtccatggggagactgaaccaaatctcatttccctcactcacccctctcccacgagccattagtggctgggaactggccctagtgatcaggtaccctaagtagggctgccagcttcctttctattcagcctcagtttcagagtcacatctccatccactatcagctttttctctcccaatatctgctcaaattatggtggctgacttaataatttggtctctcttggtgggagcagtgctttctggctgcatctagtcagccatcttgtcctcctgagtttactcatacatcctacttctgggccttctacttcctgggcttttacttccagacaatccacagctggctatgcataggatcgtagtgctcattctttcactcactcacttgtagtgctcattctttcactcactcacttgttcaacaaatcattattgaggagctatgatgtgccagataacagctacagttagagcagaaatgattctgcaggtgaactgggagacaaactctgcattttttggcacccaaatgagaaactccattcagcaagtgttgtcaattttagcagttagatattggattagaggatcccaagaaaaagaaaaaaaaacttcgaatacctcagtctttcttccaagatcaagaaatttattttagctaactcaccattcattgaggatgtcacacaaatgaagacattttttagactccactggggtaacaggatatacaggcaagtgaacaaaaaggcatgtcaaaattgaaatttaaaacttctgtttataataagacaaaattagtaaatctggttaaactcacattttgatgatgttttatttttacataatttcataaaatatgtatatgaatgtacatagatgtgtcatatatatgtgtgtatgtatatgtgtgaacattatctacataaatacacgtgcacaaacatacacacacacaaatttaaaatggtgttttctttccgtattttatttcttcttatttgttaactgtttttctctgtgcttaaaccaaatttttcacaaatttttacatgtattatcatggtgatagcccataatgacctttatgcttaaattataatgttaaatcatataaaatacaggattaagagttttgtttttgttggtcctttgacagacatgttagttgattagaagaactctaatattataacagaatcattttattatatgctgttaggtttatttcatgttttgaaatatatgtcatcaactagttttatagaaattacattaaagctctagagcggaatgttatttcttcacctatcactctggataccagatgcctacatagttccagagtttaaaataatacctggaggatttttaaaaccatgacttttataaacacaaaaagagttacctgagcaatttggggcccactctatgacatgagaaccacatacagattattagatgttgaacttcaacttgcacacgccctccatgctcatctatgtattatgtagtgcacttttgttgttaaatttcaaccactttttgttagcaactgttaaaattcttagacattcctgactcaataaaatatttcttctctggataaatttaaattatccactttatttactgttcagcgtccatgtaggttctatgatacactgtgcagtaatcattaaatcaagatacaaagaattctcagtctctcatacataatttggattttttaaatctacaagcataattcctagccacagtttaagagataataagtttccttagtgtgcaaaagttatggaatctatggaacttctagtgtatcactgctaaggactagaataatgcatagcatggagttggtattcaataactatttaggaaatgttaaagacatcttcctctggctgttttgcttctctgtgagtgtgagttgcattttaatattaattatctcattagacttgctgaatagtcttgagaattagaaaatacttattctaagattattacagttagtatgtggtacatctaacacttaaactttgggctgaatgcactacttggtacttaacaggctagattttggtgactgaatgaacaagcaaaaccatgaccaaatcaagatattctaaccaccaaactatattatttctatgaattcgtactgtctagtaggttagattgttttaaaaaaagatttttatggattgtttttaaatatagggacatgcccctttgcattcctacatacatccacttgcctaaatgcacacacagtatgctaatccccctgcacatattcacagagtattgggggaaatatgacattaatgaaaagaaatatgtggtctaaaaaacagaaagcagatgttttcgtgctcttcaatgtatgctttagcatacattttatttataacatctcagaagaaacagatgtaaatgataagatgagaagaaaagaagaatcaggataataaccaattacatgcaaggactttaggataatatttacatgggtagcatggaatcatagaacaaaattttaaaacccagtaatttatatgaatggacattacattcaaaatcccatgtttaagatgagaaagattattggttttacaggaacaagacaatattaggcaaaactgtggagtagactaacacaatgtttaggccaccttatttcttactcatcaagatctctactgccactcttaccttgctagcaaatacagtattttctcctaaattttactttttccaagaattttatttaaagacaaagccaatcactctcttgttttatttctactaagagcaataacaatgaccccatagttaccatttattgaatactgtatgccaaatatgaggttgccctttataaaatattctagtaaatcttctagaatagtaataataatgataataatgataaaccttctatttattcctcaattatgcataaggagtcttagataaattacgcaacttgtctaatatcacgtaactaataagttggaaagtcacatcctttgaaattagatctacctgattacaaagccacagtataaattaaaattacatcttggtactgctttgtgtgacacggattttaaatctgtgcagaatatgaaaaaataattgatttcatacataaaacaatttttaggtgactggctatctgattaagtctttaattttatgtaattgttcagatttttctgagggagcaaatggattgggaaagatagaaaggtattaaagacagctgcaagggctttggtctgagcagctgctcccgtttttggcctatgcaatgcaaggataaaataactgagatggggaaggctgcaggagtagtaggtttaggaaaaattcaagtgctcactcttgcacatgttgagtttgaggtttctattagtcatctaaatagagatgtcacatagccaggtggatatacaaatctggacaccacattagcatatagactgaaatttaaaagaccgaaatgaggtcatcaagaaagtgaatgcaaatagagaaatggtccaagctggaggccctagtggattccaacaattagagccctgggagaccagcaaagaaaaatctgtaggagcaattgctaacattggaggaagaccaaaagagcagtgtgaactaaattgctcacgttaatccagtaattaacctgaatatttctcagaggtcaactaagatgaggactgagaactgaccatcagattcaacaatgtaatctggctttattggagggttaagaaaaaaagcctgattgaactaaatttaaaaataaatgggaggagagaaattggaatccatattcttatgcaacacttttttagcacattgtttcaaagggaagcaaagaaatgggcagcccctggcaaagaaaggaggaataggaataagagcatgttgtgctgagggagaggctccaggagaggatgaaaaactgatgatgtaggatgaaaagtggataatcactagagccatgtccttgagtagatgagaagagaaagaatctacaagagaagagactggatttggtgaagaatggtactatctttaataacagatggaaaggcagagcatgtgggtttacatgctggtaattgtggtgatgggagtctgtgcacatttttggaaaatcaagaagccaggatatcagctgagagtattgttgggggagagaattttggatgtttaagaagtgaaggattcaattcaaggcttcagcatccttctctgtctatatcagtatattgtagaaataacatgattttctatctgtatcatgatgtgagcaagattgaaaaattgatctagtagaacgttatccacaaaatctgctaactaatatttccttttgagaggtcattttacctttttctccgtcaaattctatgattttatgctgatggtctcttctaattccaggccatgtgaccagttttatattattaggcaagtctaacaagtatattattaattaaaatgactaggtaagaaataaaggggttaaacatcacttagagagagaatgatcccagcaaaacttcatttttacatattgacactgaattattaagaacgtcatggatcacaaccacttaactggaaatgtaaacacctaaaatactatgatcaaatcacaattttgcagcttgctgattaggaggccatgtagatacagaattaaatttattacatcatggtaaattatgggcatacattaatttctttaatttgtctttctctacttgacattcaccacacatttacttaaaggaaagaaccataaatattaatatttcataataaattcagaaattcttattacaaatgctttcctttaatatcaaaagggcacacattcagtaacatgattacagtgctttagacagcattatacacactggcagtcacagtcatgcaaaattaatattaatttgattgaactgattaggtgcaaagagtcagatatttctctgaatgctgattgcattattattcactcaacaacccagtataacagtttaaagcatgggctctagtgtcaaagagattcaaattcaaattgccactcttctgctttctagatgaacaaaactttgagttagcttctctgagcctcagttttgttctctaaaaagtgggaattaaagtaggtttttaacttactagggcatttgcaaaaattaaaggaaataatgtatgtaaagcactttatgtcattgccaccctagtcactcaaaagaaaagaaaaaacttcatctttctaaatttatttttgcccagtagattgtgttgaatttgtccctttcttaattgtttttctcttgtccaaaattatcttttcacatttatccaagatccagctccagtgtcgcctctgtcatgtcatcccttcagtctagaggaatggttctttttattttcccaccactagtctgtagatcttttgtatcccttttaaggtctgcagtaggcaagttattcacatgttattgtgcctgccccttcaacttggagctcctagagaatttgaattgtgtttctcctgtttccacttgttttccacacagtagcctatgatacctgtaaacatgtagatcaggccactccatttgcctaatcccaatcctccaatagtttcctgtcacatttctgagaaaatccaaagtcttatccacagcctataagctgtacaatatatggccctggtcctctctctgtcctcactttatttcacactatctccttacacactatcctcaggcaacatgggtgtcgttgcagttcacaaagcataatgtcattgatacataaaagacctattaagtaccagctataagttgcacactattctaggcatttaggatacattagtgaacaaaatagacaaatattcttctgtgtagagtttccactgtagtggggagaagtgcagaaaaacatgtaaaaagtaaatgaaactgtatgtgacagtggggaaaggaaaatgagaagaagtagaggtggtgtggagggacaagaactagagcaaaggataaagggattcgtgagttgtgattttaaatcctccattaagtatgttttctcagggcatttgcagttgctgattttttttgccttgctttctctccagtccacccaatggttccctccaccagttaagtgtctgtgcaaacagaaacatctgtcaacacttctgagaggcccagtctaaacagtgtaaaaaggcatgcctccactcccacattacagctctctactttcttaatcagctttattttcttcattgcatttttactatgtgtaaatctgtgtgtgtgtgtgtgtgtgtgtgtgtgtattcgatgaggaaatatatttttttctgttttattaactgtttcattcctagtatgtaggaacagtttggcatagagttgtcaataaatatttattaaataaattaatgtaggtaatagttagctttagctaatgattattaaatttaaaaggtagagaaaactgaaatttactcattaatgtattatttctgaataattaaaagaactttcattttaaaacctgcttttgatacccatggcacttttttttttttttttttttgagatggagtgtcgctctgtcgcccaggctggagtgcagtggcgcgacctcggctcactgcaagctccgcctcccaggttcacgccattctcctgcctcagcctcccaagtggctgggactacaggcaccagccaccacgcccagctaatttttttttgtattttttagtagagaaagggtttcaccatgttagccacgatggtctccatctcctgacctcgtgatccacccgcctcggcctcccaaagtgctgggattacaggcgtgagccaccgcgcccggcccatggcacttctattcattcattaattcaacaattatttgttgagtgatattattcattcattaattcaacaattattagtcgagtacctataatagtctaggctttatattaagcattggaatacaattcaaaggacaaacagttattttttaaagtcattcttaattattaaaatgctctatctacattattataaaaataaaacacaaaaattgcttgtgaagatcaccacactgtctttgggttaaatcatcattcagtaacggccttagaaacttgattttttttgtcctatatgttacttactacattcttctctttggactacaagcgaagtaaaacatccgtctctggtaatgggttgggaacatgtgaattggcaaatgtgccttttattcttaggagctctggtcctgagtccaatgacactcaagtgattagtgaaatagatctataaagtgtggttaatcatacacgttagatatgtaacttttcaattcaagttgtcatacaacccagcaaaagcagtccacttaaatgccataagatgtaagtatcgttttttcttctctaaatttctacctggacatgacctgatttcaaaaatgtgcccattcaagagtgagtaggactagtttatatcttcacttggtatcaatttactgcaagatagtaaaaaaatctgttacttcctacttgggaatataaataaataatttttctggaacaataaatttaagtaagatcttcattatttttgcaaacaaaatgctaaatacatttttctggaacaataaatttaagtaagatcttcattatttttgcaaacaaaatgctaaatacatttttctggaaattttagagtttctcccagttagataaaatgcaaacacattggaaaatgtaagctttagctactcagctgttaaggtttaatattcctgatactcagctgcaaaggtttaatattcacgatactaaatattcacaatatttccttgtggtcacaaacaaaataaatctgaccatttaagaagaaaggcaggccaggcgcggtggctcacgcctgtaatcccagcactttgggaggccgaggcgggcggatcacgaggtcaggaggtcgagaccatcctggctaaggcagtgaaaccccgtctctactgaaaatacaaaaaaattatccgggcgtgatggcgggtgcctgtagtcccagctacttgggaggctgaggcaggagaacggcgtgaacctgggaggcggagcttgcagtgagccgagatcgcgccactgcactccagcctgggccacagagtgacactccttctcaaaaaaaaaaaaaaaaaaaaaaagaagaaaggcaattctagtagagataagttgactggataaataaaaaataatttaaaaaattaagactggcttattgaaaaacaataaaaacagatgtatcaaaagtaaaatatgctacagctaaatcataatttacagttttaaggaaaaaagtttattccaggaaaactccaaacaataatgattcacatcgttcaaaattttcctctggatccagaagggatgttataatggatgttttaatgcatctttttttttgtattttggtaattaaactataactaaaacccagaaccataaagatataaacaaatgtccaaagcttaaggtgagagacagccagaaaggcatattctggggccagagaatgcctaacgaaccgtatgaacttagatatctactactgattttaaactgatgatgtaatatcttgtgctgtcctaaaattagcagtgaaaatctgccttagtgacacattggggaagaaatgcaatgggatgcatttgtgcaaacattaaagaggctcagcagaggacagaatctggtaggagtggggctgagattatctaaggtaatcagaattgagcttgaagtatgaatctgaagtaaaaggtttcaggcaaatgtaaacattcctctgacatcttctaaaatattaaggtcactgagatacccatgtaaaatcaatacactgtttagacattaaagggaaaaataaaatgatgttccaaaagtcatggattcatttaccaaatattttactgagtttctaaagctatatgaattggtgtggaatgaaatgtgagcaaaacgggaaaaaaattgtcttcataaagtttatcttgcaatagaataaataaccaatttatatatcatggtagaagaaatcagggagaaaatcagagagaaggagtaggggagttgaaaaaatatcttataggtaattagggaacccctcaatgagaatttaacatttgaacagatatgaggtgagaaagggagtcatagagggctcaaagagcataacaggcagagaataagatgcaaatccaaaggtgctaggtaggcagtatagctagggtgtgactgaagaagaaagaggggtttatccaaactgagtaagtgagcaagggagtagtaggtggtgaaagcagagatataacaagaatccacattgtgttggttcttgcatggcattaattggacattgatttttattctaagtaagatcagcaagcaggctgaatgaaactttggaaggatctgagcagtgggatgccataactgaataaatgaccaagattttgaaaggatcattttagcttttggattgagaacagtggatgcagagggttagttagaggggaagaagctagttggccatgtagatgaaagctaattgtggtttatacagggtggcagtggtgaaggtaatgtgaggcatatctggactccaaaaatattttgaaggtagatttggatatgagggaaataggagtcaaagataactccaataattttcctaaagaaatgaaagaatcaggttgtcatcagctgagatggagaaaactacagaagtatcaggtttggagggaagatccagaactcaattgtcaacatgttgagtttgagatatcctttagacatatacatggagatgtcaagtgggtagctgtacatattacctaggatttcagtggagagtactggctatagatataaatttgggaatcctcagtatatagacttaagggagtaagtatagggaaagaaaagaagaggtccaatagctgagccctgtaacatcccaatatgaaagaccagaaaaataaggaagtagcaaaaaatcatattaaaaggaggggccagtaagcattagacaaggacttggtgtttcaccagtgaagcagccctcttttaggctcctgactgaagcacattcctccactatctggataatttggacagcaatccagatggaatgagaaagaaggtgatgtttcccaggccaacccaattgggtatatcaacttgggtgaccaatgaagtgacaaattaccacataataatgttcatattctgactttaagcataataataaacaacatgtgcttgcaatttgatacagggctcaatagcaataccccaaatcatttggagtgctggatgtcagtaataaggaaaatgatatagcttcctagagtaaaattttgacataagcctgtgcccagtaactttcaggtttttttcctcagcataagaatgaattttcaattaaatttatatgtagaagctcaagatataaggcatataacagtggaatgtgtttgtttgaggcagaggtaaaggaaaaaatcagaaaacagcctgctcagagttcccactggagctatccttgaagcatctggacatatccctagagcctgggtaaagcttatgaacatagctttaaaactaccaaaatcctaaaaagaaaagagttcagagatgaaaataactgatattggaagtactcagagaaggtttacatagtattcagggaaaacctgaacccaacagaatagaatgtgccctggctttcatttttatgttcctccttctgcccctacccctcagattaaatattggttgaaatacctctaaaactacacatatcatcatattggtgataaccagagtcctttagcaacaatttgaagtagattttgtttaaagaaaggtaggaaagttatagtccagaagaaaattaaactgatgtgagtaagaatatacacatacagcaaggtttacccattataggaaaacattaactgtatgataagggggaaaatgtgtttacatgtttttggttttgcttttcagaaagagaaacaagatagtgactattctcttccataactatcttggggaaagaagaagttgaaacaaaaagcaggcataataatgaatctacaatgatatctgatatgtatctattttaatcaaatggaagattagccttccagatagcattaaatagaagtgtgactaggaaaataatcttgtacggtccctcaagaggaatatgccagtttatttagagatgtgagcctttcaagaggcatccaaaatagtgaaaagagagatgctaaaaatgtataaaatcaattaaaaagagagaatacaaataagtgtcatgagaaatacaaactggtattaatagtgctcattaaaatgatgaatatcttaggcaattttcatgacctaaaatgatgtatcattggcctcatccatctactacctagaattgggacacatttgtataagactgaaagatgtatcactagtttacaaatataagcagttaagtgatctccccaaaatgttggggtaacttacatttagagtgtaggactgtcaccgcttccttttttcaaagcacatttgtaatatattcatgattgtatccttatagttgtgtgggtaaagttccttaaaccagacacttgaaagatgaacaaattattacgtgttagctaaggatattatgtttttgagttttgagtttattttgaatagtaaagtattagcactcaattttccacctaagatatagtgaaagtaagagcatgatactggggtcaaaaagggcaaattttacttagtattcttttatctcctataaacaaggcagctacattttgggtactacttaaatagctgcaaaaaaacaaacaccctacaacaaaaaataattttcattattttttgatcagaaaattatgccaacaatcctttatagtaaattacctgttatattattttgtactaaacgttttttgcaattaatctgtctttcccttgccagaagaaaagatcccatgtgaaatggtgaataggaaagcacaggtgcaatgcaaggaagaggtgttttgaaaagtgggtctttacatctataagcacttaatgtcaaaagatgctcttcttagagtagttggcatctatgtatatatatgtataaaaccttgtatatataatccagatgcttgctttatgttacttatatgtcaacttgtaaattgagaaaatatagagtagattcatacagttaatctctatatactccattccttaattattaacttcttaggttcaggaccagtccaatcctataatctgtatgttactctagcattaaccagtcccaggtcactataaaatatatatactgattttatatttcactataaaatatatatacttattatatacatatattatatgtataattatagtgacctgggcatatatatatatatcatacattaatgatactatatattattatatgtataatacatattacatatgtataacacatatataacaaaatatatattttatagtgacctggacaaatatatatatatcatatattaatgataatatataattatatatataatatatattatatatgtataacatatatataacaaaataatggttttgaagcaacttggatggagctggaagccattattctaagtgaagtaacacaagagtggaaaaccaaaaactgtaggttctcccttataagtgggagataagctttgagtatgcaaagccatacagtgatataatggacttcagagactcagaagggggagggtggagggtgaccagggataaaaaactacacattaggtacagtgtacactactcggggaacaggcacactaaaatcccagaattcaccactatgtaattcatccatgtaacaaaaatccacttgcaccccaaaaactattgaaataacaaaacaaaaataaatcaatacatacattgctaaaaatgtatggcagtatgggaaatgtcactacgatccctaaataaactgattttattatataaagactatattatacacacacaatatgtttgtatgaatagatataaattatacatatgtgtgtatacatatatacacacatatatatatctgtatgactacataagtatgctgtatataaagaacagcatggatgtcagaaatgtatcttttcagctcatgagaatcatgaggttcctagttgctaaaactatgtacttacacactttaaatggggtcatgatcagggcctaaacatattaatctctgtaagtcaaatatgtcgaggttgtctataatgtgtttgatttgcatggacatgtcctaagcacttggaaagagttgtgaaggaggaattttcacaagacaaaaatcaaaccacatataataaatagtatgatatatatgtgatgacctgactaggaatttgatggcatgagttgaatcctggctctgatacattgtgtagttgaatcctggctctgatacattgtgtagtatctattatgtgtcactaggtaagatacttaacttttgaaatcatgatttctaaggctgttaatgaattttaatgacacaaacctgaaagaaaagattcttgcaaccattatatttggacatctaatttaaggataattagtattgtaggtattaaaataaaatattgattgatttcatttatatattacctctgctaccctccaacatttttctaaacattattataatttcctgatttatttgcccttccttctacttttacttcctgtagctattttatatattattaaatatattataaatatagtatattatagtatattatttatacataagatatagtatatagcctttggtgtttgtcaaagagagagaaatgatgcctaagtcacagaaagagaaagggataattctcaataacaaaaattgtcacatttccttaaaaaacctcaaccacagggctctactaagttgacagaaatgtccagtttcaaaagcaaaatatataaagctcatatttgttattccttttctaaatttgattcataggtcttcaagttatcaattcatgctgttatttacaagattgtagattaactttacgtatatttcctaattaaaggaacatcaaactacgtagaggattcatactaggttaaaaaaaagggggtgggatgggggctctaaagctatctaaaataataactttctgtaagttggaaaataaactattttcaagctttttatgttgttcatcaaaggaatattttcttctaaagtggcctattccaacttataaaaccccaaattttaaggctacattatatgatctgaggcatcatccaaatataattgcatgatatatttgatccaatattattaaaaccttattaaatttaacaaatggcataatcttgaaaattaaggcatgtaaccaaataaacacaatgttgggatatgaatagaatttatctcttgtgctgtttgagtcaccctgcagtatgtctggtaggatgggcaaagtactgcaaacaatgacaaaattaataaaactggaattgtgtgctgcacattatgttcttggcaggaaataaggtgatgctattataaaggacacctgcttccagaaattcaattagaggactctactgcattattttcctaggaacaaaagttaaagtacattttggacgatgtgtattattttggggattgttggggtgagatgttagggtgagcaaggatttttgaggtactcagtatgccaaatcattctttattctctagacactttttcatcttgatgtaaaatttaatcattttatactacactaccttgaatcatagagaaatacacaaattagtaattgatctattttacctatcaaaactattttaatccataaaggatacttttttgcctcaggtctcatttgatgtgcttgaaagcaggtaatggtattatcaatgattatgcaaggtctcaaaatccatgactatctttaaaaagcaagagtcattttgatagttgaaagaagaatgatggttatcagaggctgacaagggtaatgggatggggagggacaaaaaggggctgataaatggatacaaattaaaatgagcatctatttataatagataataggaataaaatccaaagtttggtagtacaatagggtaactgtggttaacaataagttattgaatatttcaacataactagaggagtgggcctaaaatgtttgtaacacaaataaatgataaatgtttgaggttatggatttcccagttagcctgattttatcattatacattttatacttataacaaaatatctcatgtaccccataaatatgtgcaactattatgtacccattaaattaaaattgttttaaaaaacaaagaatgtcactctcctaggaaagtactgacagtctgttgcaactgtttttccaagacatcattactagaaagatgtcatctgattcccgtgtcacacatgggatatatctattacataactctcaataccacaatctaaagggcaatgtagacattaatttgtctcagttgattttccagtttgaaaaaaattgaaatggaactcttttatacattctgacaataatgctaagttcatgatccaagttacctaagacgcacatattaaacgttgcagaggtttttccttggaatttcaattactttcataggttgccctcttgtggccatctgtaaagctactaacaacaaaatgaaaacattgtatgtctttttttccatctagtaaatgcttcgagggtttgttaacacatggtatcttaaaattgacttaataatatgtcaggacaaaattgaaatgaaaaatcttaaatatgaattatagacaaaatcttgattgctgaaaattcagtattggctacaataaaattattcaataaatacaatacctaagtatatgagagtttgctatgattatttattaatttttaaaccatgggcattcattgattcatgaagttgatataaggctttcatttcctaaaataaagttccaatgttatacttcatataatttcaggagaaaggatattttaagatatcataagatgatttaaaaaattctttttttgaactgacatatttaatcaaccgagcacctctatcatcaaagatggattaagtaacaacatgaatacaatcaggcatttaaggtattaagcatcaattgatcccaagctacctatttaagctttccttatttgtaaaagaagtttgagccacatgatctcgactaaatccacaatccactttcttttacctttttttttttttttttttttgatatggctcactctgtcacccaggctggagtgcagtggcgtgatcttggctcactacaacctccaactcccaggtttaagggattctcctgtctcagcctcctaagtagctgggactactggcatgcaccaccatgtctggctgattgctttgtatttttaacggagacggggtttcaccatgttggccagcctggtttcgaactcctgacctcaagtgttccatttgtcttggcctcccaaagtgctgggattacaggtgtgagacaccacgtccagtcataacatctactttctatgtgtcctacttctagttagcaagaactgattagcaatcaatagctcctttctcttttttcttttttcacttcctccaactgatttctagaatgcaagtcaaaatatctattgagtcctctttgtttgaagctgctgtttcctggtcacatttgcaggtttcagaagccattctttttagagcaaagggatccaattgcacataaggcctatagcctcctgttgttttcagtgctcaaatactcaggagtggcccagagccaatacaatggaggaaaaggaccacaggcagagagatgctgagcacactgccctgggtaatctaaattagttgacctttctacctcttccagaagggatatgtgccaaaagataaggtaaaaccagctcagtatgcaccatcacaatgagaaatgaacataaatgagatcatacgagctttgaaaatgtttatgtaacaaggattcaggttatttatatataatatgaattttttaattgtataatataatcaattactataaaaaatttagattccattgaatgagcttcaatattatattctaactaggtagaaatttaaaatgtaggaatcatttaaaatacatttttggtacgaaaagcctttaagattaaaaataactgattaatgaccactacattttttcagtaaatcaataattagtctttttaacagttagaaactctcttttaattttttggggttgggggagggctggatctttcatcttcaaacatcacctctctcatccattcattaccatctatactcaatgccctctcttccacagattcaggtttgtgattaatcagtaaggaacttatggaaggagtgcttaataggtcacagagctacccaaaacctgagaaacctggcttggaaaatagaaacaaggatgaaacgcttaggagtaacctggatcacactaaacattaacctttcattccagcacccatcaagtgaggacacttgtcacagaacactaaatgtcactgattttccaacttccactgcaccctacatggtcccactaggccctaggtcactgttgcctttaagaaatgaacactgctgttgttggtgagccactacacaggatttctgtgatgggcagaattacggcttctcaaagaggtccacatcctaatccctgaagcctgtatgtgttactttatatggccaaaaaagtttacagatgtgattaagttaatgatcttgagattgaaagattatctgggattattcagtggtcccaatgcaatcacaaagtttcttataagagagaggcaggagttcaagggtgagagagtgatttgaagatgcttatcctgctggtttgtggctgaagggaccataaaccaaggaatgcagggagactcttgcagttggaaaaggcaaacaagtagattcttccttagagtctccagtggaacacagcctggctaacgctatgattttagcccagtaagaccaatttcaagtttctgacctccagataaataagataataaagttatgtagttttaaactataaaattatagtaatttgttgtaggtgcaagaggaaacatgtacaattgcccaatgcagatgcttctttgatcatcagctttcaactccagtccttattgggtgcatcagacttgccaggcccaaaagatgcagctactccctaactacaagaaaggctggaaaaagccagtatttttgtagcttctatagaacatacaggttacacttcccctaagaagtatatgatgaagaattccctgaggatacggaaggtattgagaagcccctcaaaaggacaaatatctcctattatcacactttcttattatcattattctttggactctgatataatcagcttttggaagcctaatagtcttgtcctgatgactctgataaactatttccattccttcccagattaataccttcaacagctcaaagcaagaccaaaaaacttcagaaactaagacttttgatttagctctcagagataaaggctaatttctacggtagctcaacctagatctatttcaaacataatataaaaagaaaaataaattttttctatataattgcgtaatgctttctttaaaaagaattgtgcttccaggccctgtaacatttttatgtaaagatgtctatggaaaggctatatatatatatatatattttttttttttttccagacagagtctagctctgttggccaggctggagggcagtggcacaatctcagctcactacaacctctgcctcccagtctcaccatcctcctcccacagcctcccaagtagctgggactacaggcgctcgctaccatgccaggctcatttttgtatttttttgtagagatagagttttgccatgttgcccaggctgatctcaaactcctgggctcaagcgagccacctgcctcagtttcccaaagtgctggaattacacgcatgagccatagtgcttggctggaaagtctatcaaattttttaacctgattcttattattagatattgattttaatgctactagcaatgttatcctaacagaacatttccagttattacagtgaatataaaatttggattatggaattgaatttgttggtgttgtctgatgaaaaaaaatactgctcaagagtcaggatctaaattctggaacattgaatgaatgaatggccttgtgaaaattaatttttttgagcccagttcttcttaatcctctgtcttacctaaccccaagatccgatgatatactaaaaggaagggaaaacaatttaaaaggttgtataaaattataaattcttatatagaaatacagagaaaaaaggaaagttcaaagtatacgtttttcattctattaaaacatttcttctgttgatacatggggatctaactcaagaattctagaaccttgaaattggaagataccatttcaactaagttgcaacataatttccacagtgtctactattcagtgttcatgcttctgtaagcgagttcatcatttgcaaatatatccaagagcaagactggctctgacctattggacttacagtcgccaaacacctcgcctcaagtataaagtgatagtaatcatcatattttcctcatgggttagtaatgtgtgatgtagtggcatgacataatgcctttagtgacttggcatggcatctggcacacaataactatttagtacatcttagctattaatatcaataataaggacaaattaaatatgtattaagtgtatagcatttgtatcagttcttggggaaatatactatgttcacttattccatatattttacttttataaaccattaacatatacaaagggcaggtatttttaaatatacttcttatcaaaatacaactttagaaaatattcattaacagaaaatgcagaagtgagaacttggtttgtgttttataattttaagtattttgtagaccatgaaatactctcaatataaaaggaaggtaaagaaatcaacagtgtcataaactacagttgtattttttttattatagtaatcacagacatcaccccaaatcattctgtaaatatttggcaatgctagttttgttactccatcagatgaaattattcaatttcccttaaaaatcatccttacataatttgaaaaacatataatgaataccactatatatatatgtaaatatatatatgttgtagatattgagagacacaaaatatcatctcttatctagaaattttcaagtgtacattgcattaaaattcttaaaatgcaaaagtagtttgcaaagagatcaagtccatatatacatgtaatagtttgaatgaaggaaaaactctatattgagctgaaattctttgctccttcattcttgccctctttgcctttccaattctcttgctgtatcattacctttctttaactcctggtaggaattacacaatatgtttaatttctcacctctgtcaggaataagaaaggaaatatgcaagctacaaatgcagtagctgttttagtgtctgagccaaaaaagcaaatcaggatgtgtataaggggtcccgttttaactggcaaaagcaatctgtgtcctgaggggatttacaaggccatggatactctgagctgctgtactcttctgttcccagccctgtggaccctggcattctgatagggctctagtgtagttctccatatactgattttcagtggcattggagcccatactgcaatctcagcttagtttctgcctgactaggaaaagtaatgattactgtcgttgaatcactctgcgttatatccacttggattatcacattgaatattcatgcccacccttttgatgtagtaaaaacttgatcataatcacgtctagtaaatgatgaatgtggcatttgtgctcaggcttctgtctgacttcaaaatctgtgagtgtggctatttttattacaatgtccttccaccttaatggagctataggaaaaggaaatattttacaatctcatacactttgaatacatctgggatttctctttcttatccaaaagatacaagagtagcctgcagagaggcttagggatgactagacagaaagagtattgaaatatttaatgaaccacatgctggagtcatgtgctaggtacagggttgggtactggagatttggtgataaatttttcattgtccccaccatttagttgctggcaatgttcttgagaggcagacatgcagacaatgtgatacaacatattctgaagttcacctggggacccaggcaagacaactgcactataatcatggctaggttaggcaggacagcaaaaaaaaaatacccaaagaggcaacttctaaattggtcctttaaagttaaagaggagcttgccaggcagagaaaggaaagttagatataggaatagaacatttcaggcaggagaaattttatgagcaaaggaaacaaactaaggatcgcatttatatagtgaaaattggataattaagtagataatgagattaaatggagaatattagacaagataggagagtataaaattagccataattccttattaggatggtatttaaggtaattttgtttttgttttgtgtttggagcaggggggagaggaaggtgggtaatagagaggttgcttatgtttatattaggagctcaagaaaatatgtgccaaaactgagaagaccaggtacttaaaactctgtcagacaatgctttggcaatgcttggaggtgaacagctattcaaaagcactctcttgtgttaaactggtgttaactttgtaatggcttaaaatataagttaaaatgttacattaattttttccagtaatgcattttttgtttgcctcacccaatatagatccaaataagagaacttcttgcatttccagaaatgtctgtaacattgcaatagcaggttttgttctcatgggctgctctgtataattggttagtttgaaggttggcatctttttgtagcttgcaatatgaattttggagctaagggtttaaaaatgtggataaggcaagacgtcccctccattctttctcgaaatgttcctgcttcaagtgactaatcctatttttgtaatgaaacgagaatgatttctgtaagtttattttgtggaatgaaaaaaaatgtttgagctgtttcattttgtattctttaaagcacagagcacgtttctggcctttggttgaactgatgaagcatcccaatccagctgtaactttgctatactgcagagttggaaaatctgtcaatatcttcctgcaagtgagctgttttcatgtcttaaacatgaattttgtgtggttaaaatcagttcatcacaccagaggcttctgtattgacctcttgtgaaaagtggaataatttttcttgaaggaacaatgctgcatattataatacaagtttcagaggcattatttgaattatcataattagttttgagaaccacatgaggcactgtgatcatttttgcttcaaccattaaacataattctgaaaattccagaggtaaagagaagtctatattatttacccacattttcacccttgcttgtttttttcttcttttctggtgttccaaatttccttcttttgttatttcccaatagtatgggtaatgtgtcctttaaaattttccctaaatattgtctttatcaaagaacactacataatagctctaacttccaacatatcttcattgtcattaataggtactaggagacattattttaaaacatcttgcttgcttctcagtatgtgatacaaaattaggattttattgctgcatgattggctcagattttctgatgtgagacaatgggagcaacgatgaaagtgtttgcattttattctaataaatttcaaatggaaaatctattgaaatgtcccctttccttctagaatctctactgcttatctgtcaaatataaatcaaggtgggcatactttagagtaagaatctcctgaaccttggtgactttctttataactctctttgcattttaggcagtataattattaaatttgttgctttgacttcaaaaataaataagagctgtcactcatcaatacacacattattctattaaaggaatatatacacacactcactgtttcacttactataattgtataaaaatatgtgacagaaaataataattttattaggtttatggattctttgggtcaagaattttgaaagatcacagtagtgatggcttacccttgtgcaagaatgtctgtagcctcaaccaggaaatcatgaaatgacctcacacctggggtctacagcctcaaccaggaagacatgaaatgacctcagacctggcagctgaaatcacctggaggtgtctttattcagatgtgtggtggctggtgctggctttcattggggactccagccctgctgttagctggaacagcaccacacctgacatgtccatgcggcctctttgtatgtattagtttgagctccctcacagaaaaaaaagccaagtggaagctagattgcctataacctagccttggaagtctcctaacataatttctgccgaagtcacaaactctctcagatcaagttggaaggagtatcaaagtcacactttaagaagaacatgtggaataagagatactactgtggccattttgggaaaatgcaatctctctctctcacacacacacacacacacacacacgtgaaatgtttgaattttagaaacaaagatatcttgtattagtatttatttatgcaaaacattttaccattaatctctacacctacttagatttctatgttttttaatctttttttctgtttctgccaaaagtaacactcactgttaaatgtgaaagaatatggaaatatgttacaaaataatctttttctcagtcttcaataatagcttttgatcctatctcatacctctgttctatccctctagacattaatctctattggcgccagttaatagtcctcaaacgtaaatctgattgtatcaatcataactctctgattttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgctaccacgcccggctaattttttgtatttttagtagagacggggtttcactgtgttagccaggatggtctcgatctcctgacctcgtgatccgcccgcctcggcctcccaaagtgctgggattacaggcgtgagccaccgcgcccggccaactctctgatattaaaaaaaaaaaaagtaaaggaaaagagacagctcacaagattattttccaaatccttagaatgaaattttggtttgttttgttttttgttttgagacagagtcttgttctgtagctcaggctggagtacagtggcgcaagctcagctcgctgcaacctctgcctcccaggttcaagtgattcttgtgcctcagcctcctgagtagctgggattacaggcatgtaccaccacgcccaagtaaattttgtacttttagtagagatagggtttcactatgtgggccaggctggtctcaaactcctgacctcaagtgatcctcctgccttggcctcccaaagtgctgggtagaatgaaatttattaagacacttcaaaattgtcaaactacctttgttccatttttcttaaaatggaattttctccctctaaccattcattgttgtataacttacttcctaagaacacatcttataatttaattactctatatcttttttttttctttttgtgagacggagtttcactcttgttgcccaggctggagtgcaatggtgtgatctcggctcactgcaacctctgtctcctgggttcaagcgattctcctgcctcagcctcccaagtagctgggattacaggcatgcgctaccacgccaggctaatttttttttttttttttttttttttttttttttttttttttttttttagtagagatggggtttctctatgttggtcaggctggtcccgaactcccaacctcaggtgttccgcccgcctcggcctcccaaactgctgagattacaggcatgagccaccgtgcccagccaacaatttccttttttctagattggtcttccttttcctaaactgtatttccctttatctacctgtcaaatatttggattcttccatacctaactcaaggtatggccatctctacccctacctcccctcacatggaatcatttcatacaaataatctttcagaacttacagcattgtagcatttgcttacctgcctgattcctctgttacactatgagccttctaagggtaggaatcaagcactagataataacatttgttcatccatttatactgagtatttatatgccatgaaagatgattagccatggcaactgatggcaattggttccagtcacctcaaagcttgtaggctaatgtggaaaagagacaacagtagacatattttttctttgtcctgcacatgtatcatgtgccatataccatggtctactcttccacaaaaaagcacagtttcaaattatctggttttattgaaaacaaagaaaaaggacatacatatctttaaaaggtataggtatagattttaaacgagatataataataaaatacttactccctttccacgagctatacgctatcttttgctcagtcacagaagaagaaaacttgtattctttttccccattacccgactatttttcctagttattgcttcaaatgtcctctgctttgaaatttatacatcactatttattcctcattattcttccttcttcttgtcatctcatccttttcccattcctccctagtcacttatgtcatttaatattgactttaactcttgaataacttccttatttcagcatcaattcttatcaccaccctgtatgacttgaaaatctactcaagatcatctgactgcatggcagaactatttactaaaatatagaatgtaggagaaaaataagggtagtaatgaatttgtacttcaaggtcttatgtgccatccaagtaaagtggatctagagctcagaaaaaaacctaaggaataaataatataaatatttatagataaagagataagtttatcttcctaggaattgataattattatagctacaaagagagccataagttagatgatttttatgaagagagaaaagtaaagagttgaggatgaatcttaaagcaatgtttctttgatcaatataagatgaatgcaagatgatcgctttataaatttgggatatgtacataaggatttcttagggttctgtacctagtatggtaaaatagagactgtaatttcagattttcttgttttgtcataaattttctttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgttttgtcataaattttctttcccactttaatatacttcagaaatgtctttccatatttcttctctagtgtcctgtcacttttcttttccttcctttgaaggaagtacttgttattaagggaattgtccaaagtctttagtttgtcaaatatgaaagccagtaatcttgttcatcactcagtatctctctcatgaagaaacaaaataaaactggaaaagcaataacaactaccagatgagtagtgtaggagtatgcttaactagcatcaatttccccctgcttttttttcttttaaaacatgttgctctagatcaaatttccaaataccatctgcaagaaaaacaacatttagcacatctctgacaaaagaaaatagaaactacaatagaacattcactcccaagcctagaaatatccccaacatatcaaaatactacccacagcctagaaaaataaaacacaaccacccacatttcttcccacctccagcatgactcaaacacacacattctttttaaccacaattacaattacaaagaacatctactcggtaaaaaaaatatatatatatatagtattcctaaagtcagcaataaaatataatgtattatgcagttacaacaggtgaaatgtttttagatttaaataaagaaagctgagatatatgtgtttttcataaaagttataaatgttttcttaattgataaacaatatcatctttcacataatatatgctaaatcaatgtcttttgaataggactgaaaataacgatataatatttcactgtagaatttgcattgatatcgcaatactaaattatatacgtgaggacaaggttgttgataatctagacaacctctgccctatggtgagccatacaggaaagaatctccatttaagaagcaaaacacatcaccctaataaaatgaatataagtttgcttttgaaggcagcagaagatgccaaaatttcttatataaattgaaattattatttatacctgctagtgctacgtgtatactcacttatgaggaaggagtgttagtttttgaaatatttgaagtttcggaaaacttagctgtatttaatgaccctcaaatatgagtatgattatacataaacatgtgtgtatatgtatctaaatttaatgtctgtgtaacatttgaaggactatcataaaattttggagtgatttatattatgaatcctgcatcttattgttattcagtgaaaatactccctgaagagttctttacctatacgatacattgcaatgtgataatcaaacacagaaagcaggagatacaaaagaagtctgtagaggaataagattctaacagttggtgatgataggagtgactagaaacaggatgagccaaaactcagaacgacaaacaacaacaaaatatcgtcttatcctacgtatctaatcacacttgccaaataatcataatttaattttcaaaattcctcaatatttagttttggctgcttgctcttttccttgcacagacttttgctccatattttctttattcacaacttttcaactatcttcttgatatggggatctttatctatgacttctatctaaaactccagtttaaattttctagtgccccatcatccatttccattgacagtacaattaaactttgtcgaaaacagaattaatttcaagcgagtttttccttctgagatgtgcttttgttataaccaggatactattcacaatactaccaagaaaatataaatcctaaaaataataaactcatgccattttgagcccctagaacattaagtacatagttatttattttgcttgcattatttcataatgctcctaatcacccaatgagctagcaaccatcatttacagtttttttttgcaaatgaagaaacacatgagaccttaaaaaaaattaagttgtttgcataagcctagtttttagggaagggaattggtgataaaatgaaatcgattctttattgatacataattgcacatatttataggatacatgtggtatttttatacatgtacataatgtgtaatgctcaaatcagggcaattaaggatatccataacctcaaacgcttttcatttctttgtgttgggaacatttcaaatcttctcttccagctattttgaaatatataacaggtgttaaatatagtctggaatgggttttaatcaaggtcaacttcaccgcaagtatttaaccacataaattttattatttctcattaactaagtcacctagttaaaataatttaactaggcttttctccctttgtcacttatttcatagattccaaatctcattgattattatctcaccatatgtagcatttccacttccatggccacaattcagattacagcaaattacaaaagtgaccacagttctttactgatctgcccattgccaaggtacgcacaccttgaatctaacctgtccggtgattgactgtggcccaaagaatgccccagaagtgaggctgtatgagttctgaatctgtgtctcaatagattttcatgccactgctctcagtctggagccacgggccactgctgcctattgaagacacctggtccagcctgttgggggatgaaggaccccacaatatgatgagtcgtctcagctgaaccattttagaacagccaggttccttgatctgacaactgaccacagtcatataaacaagcccagccaagttcacctgagccttgcccacatcagcagaactgccctgtagagccaacctcaaattcccaccccatagaatcataggtgaaatgaatatttactattttaaaacactaagtgtctaaggagaactaagtgtcagggtgtcttattatgcatcaaagtgtagcttatccattcaggaaaactctgctctagtcaaactgaacttcttactattctcccacttttgtacttgcatactatattttaacactttcatattcttgcattcatgtgttactgattaaattcattgaatattttatcctatcatatgacacaattctagttatccaaggcttgcagtatcaaataatggagatgatttcaatgatttatatcattgttatatatatgtagatatatacatgtatagataggtgatagataaatgtattgatatttcaactatatgatttcaattatatatattttatctcaaagactctgttataataagacttatacacatatatacacacaaaagcttacatatctgaaagttaaagaggtaaaacaaaaaagtaggaaaaatagcagattagctccagttatagaacaacttctatgcagagttatgtaagattttatgcagttattttatctctctggccttagcttttacatctgtcagaaaacttatcaccctcctatgttcctatttgtaacaaaagaattttcttggaatgttaataataatgttaataaaaactgaaaatatatgcagttccttccatgttgcaactattgtactaaagaatgctgtgtaatgtccttagtacagtgttacaataagggacaatggatataaaacaagcattgccccttattataaaagtataataatatatgtaatatatatatacacacacataatagatactatatatctattatatacatacatgtatgtatctattatatacatacatgtatgtatctattatatacatacatgtatatgtatgtatgtattatatacatacatgtatatgtatgtatgtattatatacatacatgtatatgtatgtatgtattatatacatacatgtatatgtatgtatgtattacatacatgtatatgtatgtatgtattacatacatatataacatgtattacatatgtgttgtaagaatgaaatgaacatatttatgttatatacacacaaatgtaaaaaatgtgtatatataacatatgtaataatatatgtaatatacacacatatataaattatatatctcttatgtgtatataatatatattttatatagtgtatatatctatgacatttattattacatgttatatatacacgtatatattttacatatatgttatatgtgtatatatatttcataaatatattcattttattcttaaaacatatatatccaaattacttaaaatatcattataaaaataaaatatactatcattcaacactcaattcagttggttaaaagtcaaagggattatgatttgaaactcattcagaataactgtcacatatctctctgaaggataggttttcaatagacatcaagaaactgaaaaataaacaccaaagacccctcaaccactaaaatacttttgcagacaccttccctataatttctattaattatcctgcataatgatttctagtaattacacaaagtccaataagtctacagcttctagttctttagactctggaatactttcattagatgcaacaaattatgaatgaaaataagtcgaagtagaatgtttacttgaattacatttggtaataagaatagagagataaatattgttataaccaatcaatcctggtgggcaggattatttgagttatggatcttgggaaaaaataacgatatacaggttggatgatgtgacagtgagatggtttcttatcagactgagtaactgaatttggagtcacctgaaggtaggttatcaaaatcaggtggggaaaatctggctcaacaaaatcccatgtttaaaacaatatataatttcattataaaatattttattattctgcgattttgtcgtagaagagtgatatgacttgaggtcttcaagtagtaaggtaatttggcattctaaagcatagagtgattttaaaagagataaaatcaatgttccttttctgtttggggaagggctgttttccagttctgagcttcccattaaaagaggaatagcaacaaacttttccccaattttcgaaagcaaactgagatgaattgatgtcaaatgggaaacatttaaaagaaccagcaccttgaccaacaaaaatgtcaagtttttttgaattaaattccataaaatgttatgtgcattaaacatatgctgttaaaaatacagataatacaccacagaaagattctataaaaataatcatttttaaggatacagtagtgtgttgtattataccttttacattatgataaaatttacttttgctagataatctatacctcagtatgggtaaatgatgcattactatattctattgtctgaaaatccatcaagactcactcaggcaaatagaaatgatgtttacatgaatatagctatcacatcgctggttatatgtaagttggtgaacacactaaatatatccccttaagtttggattccttatttttaaaataaagcttttctagattaggtcatattcatagttcctgatagctctgttattttaagctaaatcttagttctaagataattaatacttataaaaaagtaatcattagcaagtacaatattgcagacttgtattgagtcataacatgaaaaactgacaaaattttcaaattctattttctacctttttagttttttcttcagaagtagtatggtgctttctttctatactaatttaaaataaataaactgtcagtaatttaaaacattattattctgttaatatttgttttccattttctgtaacatggttaagcatgtgttcccacaaggtggtgctctttatttaaaaattacaacaggaagcagttttgttctatgtaagcatagtgctcaatgatgatacagattgagcatgattttaagtcgctaaatgagcagtgaaaatgcatttattactgaaaacttattttcatttgatttttattttttaaatgctaaaagtataaaacattttggtagcaatttcagttattaagaatttagaggttttaaaagttcagaaaatgcatagtagccataaacaaaaacacaaagggaggaatagtaaaaataaaattttggctggaacagaaattcttctctggaaataaagaaaagctagaatataacatagaaatactatatttaaaccttctaatattaaactaagtacagaggagtcatatactaagcacacttttttaacctgaatttaggtattcagaaggaaaaggaaataaagaaagagagataaagggaaagagagaaggaaggaaggaaggaaggagaagaaagagaaagaaggaacttttaaaaagaaattgaatagtggtattaattttactcatcatatttttcaaatattatatttcctgactgtctggtccctcagttccttcaagactcatacagttttacatctcaccctgctgaggcccaacttaatgttcaatattttacatgatttgcttacaccacccctcagcataaaccaaattatttttctggtaaccacctaaaggaagaataatatgcaccaatactgaaaaaaaatagataagagttttatttctacttcggatgtaaaaagtgtgaagggaatattgatcccaggctaaaaatgagaaagaggtaggtaattctgaaaagtattatttttttcttaaacattcagaaagctgagtacttaagacgtccctctgagatgaacaaaattccaaaggttgacaagttcctttgaggaaagacaggacacacaaactgtttaattatcagcagaacatggagccaagtgaaagcagccataaaagtgggtagtagggaggcaagtaacattttaaaaattcttaagacctagcgtgggctatcatgagaagtcagaattcctgagggcaccattccaagggaagtctgcacctgcttggacaccagctcttttacaagaggggttcagctactcctggagacaggtaggaaaagagaacaagacaatctgctgctagaggaagggcaagatcctgtctagcatccaacatttagtcctgctttgataaccaaagccatctgcccatgggagagagacaggaaacccttccataagacgcaggcaaagattggctgcactggcaaagagacaggagacactcttaccccttcctcctaggccaaggtcagctgccatgaagaaaggtatagaagtcttactcctccaaccagccctttacagtaggaaaagccatctgctactgagggaggagtaagacaccaacttaattccagaattctacaatgatatagtatattgctacaggggaaaggcaggaaatcagcctgtagaaacacccaatcattcaaggcagaggtcagctgtcttgaaggagggctagaaaacttgattgcaccctagaccctctagagaacaggaagggaaatgaagaaagacccagtgctgaggtttggtgcagagagccagcataagactggggctggaggagaactatgaagttccaatctcccctttcctttgctcctaccatgagactggcagtaagtaggaagccacaatagtctattgctagggaaggcacaggaatgcaaagagaaagccctcactcctctttcaacacagtcatgcaaagtcttctgaaagttaaaaatggaagaggaacattttgacaaaccctctgacattgcaatactcatacaaattataacataggcgcagtccataaaaggaagaattttaagcctgtgtttcactgaatgtgtccatagtgacactaaagcccaaatcaagctcaactactttctgctaactcaaactccaagttactggcctgtgagataaaggggagtggacattcaggaatacaaatatttacctcagtgtcttctgtgttttttaaccaatgcaatgtttggtatggaaggaaggagggaaggaatgaaagaaggaagggaaggagatgaaggtggggggagggaagcagggagaaaaggaggaaggaaaaaaagttctagtgtaaagcaacaaaatagtccatagaaccagaaacatagaaattcaggatgatgacactttcaggcagagatatgaaattaaaaattatggataatttgaaggaactggttaaaaaaaaagggggggggagcgtgtataaacaaatggggaatttcaacacaaatttggaaactataaataaaagaatcaaatacaaataccagaaattaaaaattaattatcagagatttaaacattcccttaattgggcttagtagcagaccagacatagtagaggaaagatcagtgaacttgaaaatgggttaataggagttatccacactgaagcatattgagaaacaaaatggaaaaacagaaaacagaacatctaaaagctgtaagacagtatcaaatggtcttatatgcaaatatattttccaaaaataatgaaaaaagaacaaatcatacattcaaaaagttcagagaattctaagaatgataagaggaaaagcgtaaccagaaaaatcgtagtaaaattattaaaaaccaaatatggctgggtgcggtggctcacgcctgtaatcccagcactttgggaggtcgaggtgagcagatcacgaggtcaggagatcgagaccatcctggctaacatggtgaaaccctgtctctactaaaagtacaaaaaattagccgggcgtggtggcgggtgcttgtagtcccagctactcaggaggctgaggcaggagaatggcgtgaaccggggtggtggagcttgcagtgagccaagatcgtgccactacactccagcctggtcaacagagcaagactctgtctcaaatatatatatatatataatatacatataatataatatatattatatatactataaaatatatagtatatataatatataatataatatataacatatataatataatatatattatatatatataaaatcttgaagacatcatcaagagaaaaagaggaactatgattaaaaattaaaggaggcttcttgtcagaagcattgaaagctagaagacaagggagcaacacttaaccaaaaggaaaaaaaaaactcaatctagaactctataaatatagaatataattttatccagaattacagaaaaagtataatatctcatgacccattatgttttagtaaaggagtaaggttagttcaacaactgaaatcaatgtatacaattcactggaaaagaaaaatcacattattttctcaatcaataaaaagcaagaaagacaaattaataaaattaaaatcaattcatacatacaaaaaaacttttagaaaactaggaatagaaaagaacttgctcagtttaaaaggggaaaattattaaaatgaaatgaaacacaacaaagtataaaatttcacagctgacattcatctatgtaaaaaaagctattagaactaatagtgtatacagtaagattgcatgatacaaagttaatataaaaaatcaatagtaagttgatacactatcaacaaaaaatggaaattaaaatattaaaacaattttgagaaaattttaaaagacctaaataaatgagaggatattccatattcatggatcaggagattaaatatgggtaagatatcaattctccttaaattgatttatatatcctatgtaatctcggtgactctcatgcagggttttttctttttttgtttatgtagaaattgacaagctgattctaaaatttactcagaacgtgaaggcctttattaagtaaaacaataaggaaaaataagaacaaaattgtagctctttcaaggattagtataaaattgcagtaataatgactctattattggcaaaaagatagacttacagatcaatggaaaagaagagagtccaaaacagaccaaaacatatatggtcacttgattttggcaaaatactatggtaatttaaggaagaaatcatagtttttttttaaagaaatataactagaacaattggctagccatatgagaaaaaatatttacatgccatacacaaaaattaatcattcacagatcataagtctaaatgtgagagctaaattcatagattctaaaagaaaaagcaggacaaaatctttgtcacctttatttagagaaaaatttctatataggcctcaaaaacaaggaaaaaaataaattggacttaatcaaaattaaaattgctctttgaaaggcactgttagaataaataaaaaggcatgcaacagattcagataaaatatttataaaacacatatctgataatggctttgtccactcactacataaaagaactctgaaacctccataacaagaagattaaaaagtaactttaatgggcatatagacagccaataaatgcatgaccacatgttcaatgtcattacttaacaagaaatggaaagtgcaaactgaataagatatgacatatccactaaaatgactaaaattaggagtgacaataccaagtgctgctgaggttgtggatcaatttagaattctcatacattattgttgatgatgccaaatgacatttcattttggcaaatgtatgccattttcttacaaagttaaatatgcactcattggaaaacatagaaattctacttgtaggtatctgctcaagaggttttaatatatatttgaatatttagagcagatttgttcataatatctgaaaattagaaatggccttaatatctatcaaatggcaactggataaacaaactgcggtatatgtatataacagaaaactattcaacaataaagaggaactattttacactactgataccgcaaaaccatagaagaatcttaaaagcattgtgctaagtgaaataagtcatattgtgtgattcctttgatataaaattccagaattgtcaaaactatcatgacaaaaagtagatcaatggttgatatggtattagtgtcagtatagtctgactcaaaaggggcccagggaaatttttagggccatgggaatgttccatatattgattgtcatggtgattaaagaactacatacatttttcaaaactaatcaaattatgtttttgtttttgttttttttttttcctgagacggagtcttgctctgttgcccaggctggagtgcagtggtgcgatcttggctcactgcaagctccgccttccagattcacgccattctcctgcctcagcctccccagtagctgggactacaggcgcccgccactgcacccagctaattttttgtatttttagtagagacggggcttcaccgggttagccaggatggtctcgatctcctgacctcgtgatctgcccacctcggcctcccaaagtgctgggattacaggcgtgagccaccgagcccagcaaaattgtgtatttttaaaaatgtggattgtactctttctctattgtacctgagtaaaaaaattaaatataccggataacttgtactattagtctttaacatgccttctttctaaaggattttcaaaaataatttgagtatttttcatttttttcttaaggctttcaaataaaatccctaatgcataagagcaaatctaccatgtatagacttatatcctataggaaataagagaaagagaatgttctggagcaagggaatgaaattaaatgtataatttagggaggtaaaactagattagtttagggaggtaaaactagattgctgaggttgcagggtaggcacgggttgaagtttagaaacctatgcaatatttctcaaataatcaattttttcctctttaattccaagtggaagattaagaatcaaaagaaatatttggcctgaagccagagattttagatttagctacctgcagtggaagctatgattgttcttgaccaccgtaaaaatgtaggtaggaacgaagagaaacatatggccaaagactgaatttcaagacaagctcactgaatacagtgggagaaaggagtctccaggcagaaatagaacagttttaaattctacggagagggcaagagaagtgaagaatgaaattaggtcactggattcaattattacagatacagatataattttcaagcattctgttttagatggaggttaaaaatcttttcacataaaatggagggaatcatagttgagagactgtagtaggagatataatgtactaatttgaggaatctggctatatagtaaagctgtagaccccaactgggaggatattatagtttcataaaaggatcttcagcataggggacattccaaagcagagaaaagtgagttaatggaaaggaagagactgctggagggaaaaggaatatctgaaggtttaagttcccccaaggagctgggagataaatgagagcagtaacatgggtaaaaaccaagagagatggaaaaactgttctaatctattaagatgtaaaacagagatttattcttcctgcaggcagaaacattaacaaaactttttttttcaaaaaaatttgagtaaatagttgaaagtcaatgtatctgtattgtattacacttacatgaccaaaacttaaacatgctattttctttttgtcttttcttttcttactactctctctttccctctacttgactctttccctcaaggtcagcttctgatgtaatgattcaaaattgtgttacttcagtggtgttatgactgaatgctacaagagtcttaaagtcttcattatagttaccaaaagattatcacaaatcctcacataacagtgaaatgcaagtttattcttacagatgagaaaactgatgctctgtgagaataagtggcttgtctaaaatcaaagagctcataagtgataaaattggaattaaactcttgggtcatttcttaggacttcattcctatctcacataaccacaatattcaagaaatattatctgttttgttctttcctttggtattattggcttttgaagatagcatccccttgtgattaattacaaagaggagtttccacagttgacagttttgaccagccaaaagaaaactagtgatcttaattccatttctgccaataacaagatgcgaccgtaggcaggttatttgctctttctgaacgttgatttctttatttgtaaagtaaggtatacagttatacagtctgtaagatcttttctagttctacatttctatgagtctaaaagtaggatgactgtgaaagaccagttctaccttggagatgagccaaatttgaaattggctatttgtttatagccttcttcactcttcacttggattttacatataaatgctatttttaaaaagtcatactagataaactggctgcaaaatttaaaacagaataccattgaggttttcggctcatgaagctataaaaagcagtgtgaactataattgtggccttacaaagttatcattggcgatttgcttcagaatttcatttccatctcatcttacatagtaaaaaaaacaacacaaagactaaagacccagaaatctcagagagctactcagaatgtattgctgaggaaaattttccctaagatattaattaggtagaaagtcctgaatgcagtcatttgactaattaatcctcatttacataaaaataaatcagttatatcaattactgtggggcaatagaatgtggttccccacctccccgtctttccttctgtaatataagattcatacattttcttcctgacagctagttatttagtgtcctttactgcacatttttcctctaatttgcttcattgttggtttggtcttagatttctttcctcccatctttctacttgctctttgtagatggtctcactattcccatatcattatatattatttacatactgttatccctgaaatttacatctcaatccatatgaagaattcacctacgccaaactaaagaacattgcccttttcttcccactcccaaccccacccaaatctttcttatgttctctgttttggtaaatgtcatgagcatctatccagtagttccccagacttaggagccatctttaattttcctcaatatacgaatccaacccatcagcaagtccccaattctaacttcataatatatctcaacccaattcacttccctactgctatgaccctaaaccaaactcccaccacttacctgaactcctgtattagcctagccctttaccagattctttttggttcagtccttgttctatttcacttaattttaagagcaaccagcataatatttttaaaacataaatcttgtcatgtaattccatagtacttccacttccatcattttccatagtacttggaataaaatccagactcctacaggacctagcatgattagctgttgcctctcactccaataccattttatgccactttgcctttagctcactacatttctgtcacagttagatcctttgttccttgtcttagtatcttagtggtgctgtagcaaattaccacaaatggatcccagacatccaaaaccaagttgtcagtagatttgtttccttctaaaagctccaaaagaggatctcttccatgcctccctcccagattctggtggttgttagcaatccttggcattccatagattgtagaggtatcactccaatctctgtctccatttcagatggcattctcctgcaccagtcattagatttagggcccaacctaaatccaggttgatttcaagatctttaactaatggcatctataaaaatcatattaccaaataaggtcacattctgaggttctaggtggatataaattttgaggggacaatatttaacccactgcatttcttctgctatttcatctccctgatcttcagatggtccatcttctgaaaatcacttcctcagagaagtcttccttgatttccttcctttcttcatcatagctccctgctgtttccttcacaatgccagccaaacaagtatcatttcagtggcatagtttgtatataatatatgtatatgtgaatacatactaaatatagatatgagtaaacatataaatatagtaatatgtgcgtataagtgtatatactttgtgttatcagctaagaatatgggaacatttcttaatttaactgtcatggcatatactcaaaaaaagccagtaaacaactggagtattcaaggaatggaaaaaaattaaaaaaaaatcatctgtagaatgaaaagtactagcgaagaagaaaaaaatttaaaaaatctgtggatttaaaaaataataataaaatgagaaaataatgtaaatgtaaagaaaagatacagagtgataacaccttgtattatataagatgttgaaaaaaacatctattttatactgattttttttcttaggctgagagatagtaagtcccaatattaacaaatgtaaaataaacaaaacataattgtaagtaaaaactgcgagacacttgatcactattttaaaagcctactaacataaaatcctaactaattactatcaacgatgtatggatcttggtgatttgtttatagaattaaatttctgcacagaagaacaaaacaaaaagaattgcttcataagtcttcctcctagcatgtttttctggctatataatgagtatatagacctagcatttatggaataaacccaactatctcctgaggtcatattctgtgtattgcttcatttaattaactaattataaaataaacatgagctccaaaggagaccgtaagctccagatcagaaagcagccacaccagcaccttaattgcagtccattaaacactaagcagaggattcatctaagatgttcccagacttctgactcccagaaactgagattgttattttaagtcattaaggttgcgtcaatttgttacgcagcaatagaaaatgaatacacctaataaaacaacttgggaagcgcttcttctttttaactgtctgttagagcttttaataggtggtataattccttccttaaatgattgtagaattcactggtgaagccatttggtcctgaagttttctttgtgagaggagatttttaattgaagattttttcttttatgtgaagtatcacctgaattttttatttcttgaattaacttggttgaagtgtgtttttctaggaatttgtccatttcatccacaattttagattcatcagtataaattctgttgaaaatatcgtcttatctttgattgtctgtaggacctatagtgatatactcttactgagttctgctattgtttatctgcaccttctcacttgtttatttgatgaacccgccagagagttgtcaatgttaattttcccccaaaaatcaacttttgcctttatcctctatattaaatattccaatatattttattaatttctgctactaacaccattatttttttctatatattttaggttttatttacttgtttttccctaggttcttagattaaatgtttatataattgatttttagcctttatttttctaatacatatttttaaaaatatattataaatttctctctaagttgggttttaactgccttccacatgtgtcaatatgtagtatctcaaaatgaatcaaaaaaattcttatttgtacttgaattattttttggccaatgggttaattagaagtgtctatcttgttttccaaaaattttagcactttttagttattatttttaaaattttcatgtttagtgttaactactagctgaactctgctgttaaaagaaaatgtattctatatgatttcaattctttgacaattaatgtgtttatctgtatatggccttcatttggtcaatttggggaaataaagtaagcgctctatatatgtcaccaaggccaagcttatttatcacattgctcagattattatctttacagactttatattctagtccaatcagatctgcggagaagtaaaataaaatgttctaccatgattgaggcttttctattctccttttgattctgttaatttttgtatgtatattttaaatatatgttattagatgtataaacattaaaaatttttctacctacctggtacaccaacttcaatattgaaagctctctttttaaatctattattttttgaaagaccatggttattgacattaatgtagttatgtaggctttttagttagtattttatggtataccttttctatcactttagtttcaacctttatttaattatcatatttgttctctcttatctgttattgtctgtaggatctagctgctcttctcgaggagtatctttgtggcgtattttagaatttttttgtaaatacatggtttcaaaaacattcttgaattttatcttgaattgaccatttttctacttatatttaatgcaatttcttacatgcttttgtttaaaagttagaatgatgatgttggttgtaatcagtttttatttaaattcttgacctgttagagaatggtgatttaaattaggtgaaatctagtgtttctgaataggtgtatgcggaagatttctccagacttcgccatgcacaatatgtccatgtaacaaagctgcatttgtaccccctaaatctataactcaagaaaataaataaaaataattttgcagaaggagttgtcaatagaagaaaaatagtcattcatgtagattagccattgtaatctgtgataaaggaaagaaaaatttttaaaaataggattttctataaaagttctcaccatgcttcaatcaaaatataaattatgtctatgagtaaaatataagaatatccagagaatttattatataaatgatttagttactttcagagaactttggtgaactcttttggtaaaatattaaatattaaatatatataattttaactcctcttcctataatacttataaatcttctaaatgtactttaatagattaaaatacctctttgaaaaataatttaatagccgatcataaaatctttagggcatattcctattatgtggtattctggaatcaacatagattttaattgtaagtaataattctgcagaatctcaactttaatttattatgaatatacaatcagatccatttttaaagtgcctgtagtggttataattaatgttaagtgaaaaaaatgcataaatttcacgttttgctgattaatgtttccctgactgtaagcacttgaaaagactgtctagttacagaagaaaagctagaacaagttattttccttccagatgagtgctccttaacacagagacatagctcccctgggaaggttaatgctgccgccaatcttctggagacccagagaggggaaagggaagaatcccaagccaaagaggtttgcaatttcctacaaagccaaagtttaatgaatactaatgacagaacagggatggatccttggaaaactagctcatttcttatcttgccaaaagagatagaatgcagtaccaacttactggggtccatggagaagcaacagaagctaccttggacctgtacacgtcctgttgcctcgggctatcctggagattggccttcagactcaccttcttagagagccatcttcattctttctggaatgactaagcaagtatcaaccctaatctaactgagattgaacaggctattaggctacacagtcacagggaggatgtttagggttccctagaaaaagtaaataattttgaaaaagatttctaagaatcaatttcaattttattttctaaataaatttggcaattaaatgcaaactgatgtaccttaaacagttgcagtagctagcttttgtaattgctaaagtctgtagaattgaaatacctttggaccaagaaaagaaagatccttgatttattcccatacataatgaagatcttaatgtaatgcaaattagttatttaagacctggttcaacatctacctctcaaaacaagtcttccaaaaaaataaaaataacccccccaacccaaattaccatgattatttccatataatgcaaaattaatcatttatttatgtactcatttttacacttgttaatcatgtgttaaaaagaaatgattgctggctgggtgtggtggcttacacctgtaatcccagggagtgggaggccgaggcgtgtgggtaacctgaggtcaggagtttgagaccagcctgaccaacaaggagaaatcccatctctactaaaaatacaaaattagctgggcattgtgtcatatgcctgtagtcacagctacttgggaggctgaggcaggagaatcacttgaacccaggaggcagaggttgtggtgagcccagatcgtgccattgcactccagcctgggcaacaagagcaaaactccatctcaaaaaaaaaaaaaaaagaaaagaaaagaaaaaaaaaaatgattgctaaccaattagagtgcaaaaatttaaagtaaagggtcaatattttttattttttataaagtgctaagaatagtactaagtgtacaacagacattactaatatgctttctctataagcctttatctttacttcatatttttcacattttaatgagtaattatatgtataaagctgtattcatccatctgttttttccagaaaaacatctatctttgataaaaagtaaaaatcgtttaactttattgtgttagatgagaacagtctaattagaaaccagtctcttgttaagaatttaaaagatcaagaaacctgttctatttgctgtagaagaatatacgtatatatgtgtgtgtatatgtgcatacatatacatatatgatatataaaaatatgttacatatgttttatatatgtttaagggttgtatataaatgccttccaacttacatgcaaagaaacaaatgtatgtctaataaacataaatagaaaaggaagggagaaaaaaagaacaaaatacaaacatttgcaatttctatggttaaaatgatatttccatttttgacaaaactatggaattctagggagcaaaaacacttgaagtaaaataatttatattgcactttaaataatttaaccaggaagttgaatatatattaatatttattttgcatattttgccctatttcattaacactgattttccttcacaagcctttctttaaatacctttttcctttagattagttataaattaacagtacaacggagggcggttccaagatggccaaataggaacagctccagtctacagctcccagcatgagcaatgcagaagacggatgatttctgcatttccaactgaggtactgggttcatctcactggggattgtcagacagtgggtgcaggacagtggtacagtgcaccaagtgtgagccgaagcagggcgaggcatcacctcacccgggaagcgcaaggggtcaaggaattccctttcctagccaaggaaaggggtgacagacagcacctggaaaatcaggtcactcccaccctaatactgcactttcttagcaaacggcacacccagagattatatccttcacctggctcgaagggttctacgcccatggagccttgctcattgctagcacagcagtctgagatcaaactgcaaagtggcaatgaggctgggagaggggcgcccgccattgctgaggcttgaagaggtaaacaaagcagcggggaagctagaactgggtggagcccactgcagctcaaggaggccctgcctgcctctgtagactccacctctgggggcaaggaatagccaaacaaaaggcagcagaaacctctgcagactttaatgtccctgtctgacagcttggaagacagtactggttctcccagcatgcagcttgagatctgagaacggacagactgcctcctcaagtgagtccctgacccctgagtagcctaactgggaggcaccccctagtacgggcagactgacacctcacacggccgggtacccctctgagacaaaacttccagaggaatgatcaggcagcaatatttgctgttcaccaatattcgatattctgcagcctccacgctccaggcaaacagggttggagggaactctggcaaattccaacagacctgcagctgagggtcctgactgttagaaggaaaactaacaaacagaaaggacacccacaccaaaaccccatctgtacatcaccatcatcaaagaccaaaggtatataaaaccacaaagatggggaaaaaagcagagcagaaaaactgaaaattctaaaaatcagagctcctttcctcctccaaaggaacgcagctcctcaccagcaacggaacaaagatggatggagaatgactttgacgagttgagagaagaaggcttcagatgatcaaacttcccgaggtaaaggaggaagttcgaacccatggcaaaaaagttaaaaaccttgaaaaaagattagatgaatggctaactagaataaccaatgcagagaaatccttaaaggacctgatggacctgaaaaccttggcacgagaactacgtgacaaatgcacaagcttcagtagctgattcgatcaactggaagaaagggtatcagcgatggaagatgaaatgaatgaaatgaagtgagaagagaagttcagagaaaaaagaataaaaagaaaataacaaagcctccaagaaatatgggactatgtgaaaagaccaaatctacgtcccattggtgtacctgaaagtgatggggagaaaggaaccaagttggaaaacactctgcaggatattatccaggagaacttccccaatctagcaaggcaggccaacattcaaattcaggaaatacagagaacgccacaaagatactcctcgagaagagcaactccaagacacataatcgtcagattcaccaaagttgaaatgaaagaaaaaatgttaagtgcagccagagagaaaggtcgggttacccacaaagggaatcccatcagactaacagtggatctctcggcagaaactctacaagccagatgagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgcactaaaagagctcctgaaggaagcactaaacatggaaaggaacaaccagtaacagccactgcaaaaacatgccaaattgtaaagaccatcgaggctaggaagaaactgcatcaactaacgagcaaaataaccagctaacatcataatgacaggatcaaattcacacgttaacaatattgaccttaaatgtaaatgagctaaatgctccaattaaaagacacagactggcaaactggataaagagtcaagacccatctgtgtactgtattcaggaaacccatctcacgtgcagagacacacataggctcaaaataaagggatggaggaagatctaccaagcaaatggaaaacagaaaaaggcagggtttgcaatcctagtctctggtaaaacagactttaaaccaacaaagatcaaaagagacaaagaaggccattacataatggtaaagggatcaattcaacaagaagagctaactatcctagatatatatgcgcccaatacaggaacacccagattcataaagcaagtccttagagacctacaaagagacttagactcccacacaataattatgggagactttaacaccccactgtcaacattagacagatcaatgagacagaaagttaacaaggatatccaggaattgaactcagctctgcaccaagcagacctaatagacatctacagaactctccaccccaaataaacagtttatacattcttctcagcaccacaccgcacttgttccaaaattgaccacatagttggaagtaaagctctcctcagcaaatctaaaagaacagaaattataacaaactgtctctcagaccacagtgcaatcaaactagaattcaggattaagaaactcattcaaaaccactcaactacatggaaactgaacaacctgctcctgaatgactactgggtatataacgaaatgaaggcacaaataaagatgttcttcgaaaccaacgagaacaaagacacaacataccagaatctctgggacacatttaaagcaatgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagataagagcagaactgaaggagatagagacataaaaaaacccttcaaaaaatcaatgaatccaggagctggtttttggaagagatcaacaaagtcgatagaccactagcaagactaataaagaagaaaagagagaagaatcaaatagacgcaataaacaatgataaaggggatattaccaccaatcccacggaaatacaaactaccatcagagaatactataaacacctctatgcaaacaaactagaaaatctagaagaaatggataaattcctcgacacatacaccctcccaagactaaaccaggaagaagttgaatctctgaatagaccaataacaggctctgaaattgaggctataattaatagcttaccaaccaaaaaaagtccaggaccagatggattcacagccgaattctaccagaggtacaaggaggagctggtaccattccatctgaaactattccaatcaattgaaaaagaagtaatcctccctaactcattttatgaggccagcatcatcctgataccaaagcctggcagagacacaacaaaaaaaagagaattttcaaccaatatccctgatgaatctcaatgcaaaaatcctcagtaaaatactggccaactgaatccagcaacatatcaaaaagcttatccaccatgatcaagtgggcttcatccctgggatgcaaggctggttcaacatatgcaaatcaataaatgtaatccagcatataaacagaaccaacaacaaaaaccacatgattatctcaatagatgcagaaaaggcctttgacaaaattcaacagcccttcatgctaaaaactctcaataaattaggtattgatgggacatatctcaaaataataagagctatttatgacaaacccacagccaatatcatactggaaggcattccctttgaaaactggcacaagacagggagtccctctctcgccactcctattcaacacagtgtgggaagttctggccagggcaatcaggcaggaggaggaaataaagggtattcaattaggaaaagaggaagtcaaattgtccctgtttgcagatgacatgattgtatatctagaaaaccccatcgtctcagcccaaaacctccttaagctgataagcaacttcagcaaagtctcaggatacaaaatcaatctgcaaaaatcacaaacattcttatacaccaataacagacaaacagagagccaaatcatgagtgaactcccattcacaattgcttcaaagataataaaatacctaggaatccaacttacaatggatggaaggacctcttcaaggagaactacaaaccactgctcaacgaaataaaagaggatacaaacaaatggaagaacattccatgctcatggataggaagaatcaatatcatgaaaatggccatactgcccaagggaatttatagattcaatgccattcccatcaagctaccaatgactttcttcacagaattggaaaaaaccactttaaagttcatatggaaccaaaaaagagcccacattgccaagtcaatcctaagccaaaagaacaaagctggaggcatcacactacctgacttcaaactatactacaaggctacagtaaccaaaacagcatggtactggtaccaaaacagagatatagaccaatggaacagaatagagccctcagaaataatgccacacatctacaaccatctgatgtttgacaaacctgacaaaaacaagaaatggggaaaggattccctatttaataaatggtgctgggaaagctgactaaccatacttagaaagctgaaactggatcccttccttacaccttatacaaaaataaattcaacatggattaaagacttaaatgttagacctaaaaccataaaaaccctagaagaaaacctaggcaataccattcaggacacaggcatgggcaaggacttcatgtctaaaacaccaaaagcaatggcaaaagaagccaaaattggcaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaaaaaccccatcaaaaagtgggcaaaggatatgaacagacacttctcaaaagaagacatttatgcagccaaaagacacatgaaaaaatgctcatcactggccatcagagaaatgcaaatcaaaaccacaataagataccatctcacaccagttagaatggtgatcattaaaaagtcaggaaacaacaggtgctggagaggatgtggagaaataggaacacttttacactgttggtgggactgtaaactagttcaaccattgtggaagtcactgtggcgattcctcagggatctagaactagaaatactgtttgacccagccatcccattactgggtacatacccaaaggattataaatcatgctgctataaagacacatgcacatgcatgtttattgcagcactattcacaatagcaaagacttggaaccaacccgaatgtccaacaatgatagactggattaagaaaatgtggcacatatacaccatggaatactatgcagccataaaaaaggatgagttaatgtcctttgtagggacatggatgaagctggaaaccatcattctcagcaaactatcacaaggacaaaaaaccaaacaccacatgttctcactcataggtgggaattgaacaatgagaacacatggacacaggaaggggaacatcacacaccggggcctgttgtcgggtgggggcaggggggagggatagcattaggagatatacctaatgtaaatgatgagttaatgggtacagcacaccaacatggcacatgtatacatatgtaacaaacctgcacgttgtgcacatgtaccctaaaacttcaagtgtaataaaaataaacgtgaaaaaaatttacggtacatcaaaaggaagactctttttctaacccagagttgtttcattactcagagcttctcaaataatttgacagatacagcaaaaaattatttctaaaatgttttctatcacattaatcatcagaatgattaaacaatatgttaagatatttccaaaatgcttcccacatttgtaacacgtaacactcagtgttagcataaacttaacttttaggtctttcaggtgttagtctgaaagttcctatttctttgctcacttctatatttaacataatttaaatttttgattatggaaaactacatttgcatgtgccctctaagtagtttgattgtgttgaaatatagatgcttaagtagttctatatcatagcagttacagtggtaaacatttagagaggacttgcgtttgccaggcaggtttggagcactctacattgctggctcattaaatagaaccatcttgtaaaagatcctgttttcatcataatcacatggtttaagaaatagaggcagaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccatcaacaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttctacactgttggtgggactgtaaactagttcaaccattgtggaattcagtgtggcgattcctcaaggatctagaactagaaatactgtttgacccagccatcccattattgggtatatacccaaaggattataaatcatgctgctataaagacacatgcacatgcatgtttattgcagcactattcacaatagcaaagacttggaaccaacccaaatatccaacaatgatagactggattaagaaaatgtggcacatatacaccatggaatattatgcagccataaaaaatgatgagttcatgtcctttgtagggacacggatgaagctggaaaccatcattctcagcaaactatcacaaggacaaaaaaccaaacaccacatgttctcactcataggtgggaattgaataatgagaacacatggacacaggaaggggaacatcacacaccggggcctgttgtggggtggagagagtggggagggatagcatttggagatatacctaatgttaattgacgagttactgggtgcagcacaccagcatggcacatgtatacatatgtaactaacctgcacgttgtgcacacgtaccctaaaacttaaagtataataaaaaataaaaaaaagaaaaagaaatagaggcacaaagaagaaagtaaatttgctcaaggttacaaacagctatcaagaggttgagtcaaaaatcaaattgaggctgactttccagagtccacactctacaccactacatcttatgctattttgcaaggattacaagaaattgaaatcaaaggtttatataaaatatggtttgcacacaatattgtatactttctataattttattaacttttaataaattgtagtctgaactgactctatgtgtacacttgacactaattattttggaaactttcctagcagttaccctttatcatctttggggcatatacaaaatgttaaccattctacatcaccaagcttctccagcatgtttatcctagtgttctgtgctttttctcttttacctactttccactatatcttcccctcagacttttcactgtgcctttgaaacctctattttacataaaacaatctttcctattttatcactttgttgaaggagcccatcatcactttacctcaacgaaaatagatttaaatggcttcataggttgcaccaataggatgcttttccaaattcctcagctcacttaacttcagaaagcagtgttagcacctttcttgaaaaccattagaatttccaacccattactcctccattctaaagtagaaccatctctactttggtgctcacaccatctgactattcctcctgttactcctccccatcattaataactaaaaatggcatggtctttttaacatgtaaatgaagttagttaatgaaatgacttcaattcaaacaagcaactacaatcaagtaacagatcccaaataaataataccttcatctttcatcaatcttgttattaaacaggctttgtcatatattccctctacatgtctggacttcagcttgagcagattcataactttccagtcacttagagttacaggaataaatctcattgtggatatccagaccattttcaagttcagaatatccagtacagcccaccaccaaaatttaagttacttatttaacagagaacttttctgatcaccccaccttgaactactagaaaagaggaagatgatccactttttcacctgcattctatctgcttcataggtctttcttctaggttggggcagggatatgaaagtgggttacaggaaaaaaagcaaagttttataagactggtgacttctatgttccaggtgccaaaatactggacttctaaattgggactcattagaggattctttggaggtcctcccatggggacatcccatgctacacagatcattgacataggcaattgctatttgctttctgactaaccatttgcctcctgccaccacctcacatttcagtttatattcttggcaaaacagctgacatcctattaattcttaatactggatcccattgccctagcaggcagtcatcatataaagggttctattatccttctacttcatcagtctggcccatgggaagctcatgtacctttgacacaccaaattcttgttgtaaagaccactcttactgctattctttctcactggcctaatttaggttagcttaaccagacttctacctcccaaatttactggagaagaaacaaacatctgattcagtggtcttgcatgtccgcaaactccaaggaatgcacattaatttatttcttctcttaccttacatctaacccatggaagtacttgatatattgctgaaaaaatatcaaaatacgaaaataccactgcttctttctatgagtcattgctttgggtccaccctcatttggctaaggagaagcacacacttccctccacagagtaaaaaccctgcagtactccctaccagctgacagctctctgctaatgagtcatctggtcttctctaagagagaataatagtggtgattcatagtggcaggactgatgctgccattattacaagtctgtggtgaatatgtctaacacttctccaaagaatgtggggatacttatcatcaatggcactatgttttggggttttaaagataactatgattcaacaatggaaacctcatttcacattttttaactcctgcattttttgaagttttcaattactggttcacactattacaatctgagacctgttatcatcatcattcttgtttaatttatgtttattaaatacttattgaaggcatactatgtgccagcgttggtggtccagcattaaaccagacagaaatttctgctctcataaggtttctattccaatgatgttaaacaatgtaactaagacatacggcattctaaatttgtccctttgattttctctactgttatttcttccagtggtcaacatttaaaggtttccctgggtcctatttctttccctaccataaaattctattaatactgattttgtaagttttttttcatttgctattgtcatttttactaccactactatagtctgaagttcacctttgtaattttattccagaattattataataccctcaatctcctttttccatgcagtatgctgctagagttatcattgtgagcacacaaatatgtccatgtaaatcgtgtgctcattaacatctgttctaattcattcattcaaccaatagttattgaggaactcatatgccaagtattataaatctttattctataatagtgaaagaaagagacaaggcttgtaactatgtaaagtttatattctagtagaaaaatataaacaatcatcctataggatcagaaaaaataatattgagtgttcacggaaaactctgttaaagtgacaataaaacaaagacctaaagaaagtgaggcagtaagccatgaggatatctgaggggacagcatggcacaaagaaggaaaaatgacaagcgtattgtcccttaccagtaataaacttgtctgggtaaaggggacagcaatggctagtgcagcctaagtggataagctatggagaaaaaggtagaaggtgagttcctagaatcatcgtaagggaaggaagtaatgaagagtctcagaaaccactccatgagctttgggaattttattgtgatgggaagctaacatagctttaaggctaaatgtaacatattgcaatttacatttcataaaacctgtccttggttcatagagactggacagatgagaaagaatggtggctttaaacacagtggtagttttggaggattctaaataaattgtgaagacaaagccgaattatgactttaagtgtttggcttttgagaagggtagcatgaagtagcccttaactgagaggggaaaatagcaggaggtttgtaagagtgatagagggaatcagaagttcaatttttaacttgttatgttttaaattcctatcagatatacaagtggacatgtcaaatgtttagtcatatacacaaatctgaagttcaagggagtgatctaacctggaaatataaatttttcagttattattatttaagtagaacttatgctgtgaaatagattgggccatcaagggcctgaatgtagatagaaaacattgcagggcccacaaaaatgattcatccaacactgtggcctcccggttccttaatatcatcaattccaattagcctcagtccctctttatttcatcacccatgtctatgaccacaatctggaatttactagtacctggaaatattttggttctgaaatgcttaaaccaagcacacaggtaatgacaaaacacactcaaatcttatctccttaaaataattgtgcctcaatcccatctcctctattggctattgcttcctctgacttcctgcataaccaagctcttaaaatagttctctacagtcactgaatacagttgttagtcttccatttaatctctcaggcccctggaaacttgattttacctaaattactctactacaattactctcaccaagataatttcttcttgttaaatacaatgaacatagtttgtgaactctcaacatcatgaaactgctaataaccctcttgccatcctctctttaacttggcattaatgattctcacatttctggtatcccatccttggacccatctctgttttgtcttttttgaggcacattcttcctctgacctttacttaagtgcttttctttctcaggctttattctgaactctctcatcttataactctatatacatgttttttgggaggatgatgtcatcaactccaatagctttaattaagtcttctacatgtccaaataaatagctttaaatgagacctcacctttaaatttccaaatcattcatatattcccaactcagctcaacttaacatgtctaaaactgaatccctcatttcccccttgaaaatgctctatctcgttggtttcttgtcacgatgaatggtaccttcatccactcaattgccaaaccagaaagttccaatatcagccttgacttctcaataggcctcagtctgcttccaaacaaccacctattcttgtatgttcaccatgttctcagtatctcatgagtcaatccattcttctccattcttgttgtcaccttacaggcttttattaaccatctaatttttttaaaaaataatgtcaagtttctcctgtgatattgccctcagttattgttataatctagggagacagacaaaaaaaaagtcaccatgatcattttcatcactatcctttggaagaaagactgcaagtcttttcataggtctctttgctttagtcttttctctaattcgctctccaactggtaacaagaaaatgtttctaaagggaagatctcgttgactcttctgtttaaagacttcaatgcttccctttggtctttagtataaagtacaaattccttccatgtaatttatcatattcttgcccaggcttaactttctagccttctatctcacctttatctgccatgcccaggttattttatactttactacatgacgttattttctcattttttacttatgcagatgctgtttcctctgctgaatataccatggtccccccatcacttggcgaacttcaattcattctacaattggcaagaaataaattattattttctatttgccttgcttgtttctccagcccctttctattcccatcaattgcattatgtgatactcttacttgctttcatctcatcttgtgcttacatgatattataattggtttttgccaaactgttcattcaagtatattgtaagattctgaaatgagtaactgtgtattgattatcagtgtctccaaaacctaaccaaatgctatagtacagcctagcacatagtgtacactcaaatatatattgaatttgaaataaacaaataggaaaatgaaaggaaataatataacaatataaggttgaaatacaacaatataaggttgaaataatttaaattaggacacgattcagattaatattattttattatcttatctgttgaagtaaatgagtagaacattgtcacttttgaataatcaaattaaaatcagttttgtagatttttaaactctaagaccatttacaatttaaaatatatataatttggtctaaacagcacactcagaaaattgaaattgttttaaattctgtggtgtgtttatctaaattgctaaggaccatcaggaagacaattaaaatgagaacagaaagtacaattctgtttcctcagtggggaaaaaaaacctaatagagcttaagaatgttcaggacagtgtgcatatcaagcccaaggatatgaattagatgggtaatcacttattcatcacactctagaaataaagagaaccattagcatttaggaaaaaaactaaacttagaacatttaaaagtattaagttctatagggagcaaaatgtatagatcttattattccaaagaaataaatagaaagaaaacaaggaagaaactgaataccttcagtggtattcttgctataattactatatgaggcaatgaagtagatttaatttaaatcctgataataacattttgtaacatacaatgaaacatcttcacatttgaccaatgtatgttacaacgaaacatgctctggaatgtctcatgtagtctctttattagatttttgtcaatatcagcccttaaaaaacatcagaaataataagaaagtaaatagctacataacaatcaaaatattttcctaaaccaaattgcaaagagaaacacctttcattgtgtatatacagactctgcttgagtctgttatcactaaacttaactcgtatggccaagctgatccactaaatcctacctgttgacttacacctagtccacagtctacagacaattctggcaccagggcaggggttgtcttaaaaattacacctctctcctactggctcatgggttcaacacaagaagggatccttcacactgctggttacacactgacctgcacaactacagctctccagatagcaggttcatgctttacagatacataacagagttcatgcattgcaccccagtacttcagtattcaaagtcctcttggccataggtaccagacatggatatactttaccctggccttgccaggggttggctgacaatgtggggcactttgattctttacagttcccaagttttttacattttaatattgctcatatttaaaacataaaacactatgacaaagtggtatatttacaaagcactatttaatttaataacgaattttgcactttcaattttgattatctagtttcttttcctttgtacttctatgtaaatataaattctatgctcttatgctggaggttaatctgtgatcaaatttttatgaatggaaacatatgccaaatatagaatatcttttgatataattttcaaagacagctttaagttaatatttaacagatactatttttttctccaatgataaaagcatttattttctaaaataattatgtgatttggaaaaatctgcaagttgtgtttgctgctacaattaatttacagtttctgaattaaaatccttttcagaaacaggccatttgtaaaattttgaatcacccttgaaaatcatgaatgagtgattttctttttctttattaacattaaaactgagaattttcaataaaatctattgaattttcaataaaatctatttaacacttattgttaaaaatattaatacaaaattctcctagagttctcaaatttattcttaccagatatgcaaatttacttataatgacatttgcaaatttgacacaaccttctatatatgccttaccatttgaaataacaaacttcactcttttttctaatgcttcagaaataacatttatgtgtacccacagcaaaatttgcaattttaaacataccattaacatttcaatatacctctgagatttctattacactggcaaagaaattacttgacagctatgcatccttatgagagatcattcactcaatacttgatgtattctgttcaataaatgaaaaaatataagactttgaatttcttaccaatgaaaacatcatcatagaatggtttctagaaaaagcatagcttttgaagtagacaatagtattttgatgatctattaaaatgacattttttagagaaaggaaaaaatacactttgggaggccaaggcaggcagatcacttgaagtcaggagttcaagaccagcctgaccaacacggtgaaaccctgtatctactagaaatacaaaaattagttgggcatgctggcgcatgcctgtgatctcagctactcgctaggctgaagcaggagaaccctttgaacccaaaaggcagaggctgcagtgagatcaggctactgcactcccatctgggtgacagacagaacaagactccgtctcaaaaaaatttttttttaattttaaaaaggagaaaattattttaaaaacttgaaattgatttagattatgtataatttaatctgactttcagttttctaacttggaggcaaaaacaatagcttcattcattgctttattcttaaataatggaagtaaccctagatactattgggctaaatacctagataccttagatacttagggctaaagaaaatgactgttacatagctcccggcagtatgttctagatagctccttaacaatgggagacactaaattaatgtgtactactgaacccctagattagctaagcccttatgcactctgaaatgttcataatgttttccactctacaaaatgttataaaataagcacaatcattgaaacttcagaaaacgtaagtataaaataaccatcatggtatagcacagccaagaaagaactatcctcttcacaatattataagttgttttaaaagaaaaaaatctatctatctaagtatacatatatagattgatatactatacacacatacacacacacacacacacacacatatatatatagagagagagagataaagttgtataactcatgcctattcacttttatttattgggaatgacattgatgtcgtttgccttcaggataccatttttcctttctgtgacctttattttctccctgcaaaaggattttttcaacaactaggccacatacccattcaatctttcatgtttagaaacatgctttcttagagggtatgacaaactaacttattttaacatgtaaataatggataagatctttatcagtacttagcagaagacagatattttattttgctttgaacaagagacaaatcctttgaaaccaactaatctctaactgtagaattcttccaggaatcagtgaacagttgagggaagtattttgaaggtagtagatctacttttctgatgtaagttgaattctatgggcaagcactgtgcaaggcagaagggtaaaattacatcacataagcactcacctgaaatacttaggtaaaagactggccattaatcctgtcaatatactttctgggttgacttacatttcatcttgccttacattgtaatgtaataggtctaggggataaatacaagcagctgtctgcagccaatacatttttccacataaatacttatgataaaaataaaaagaaggaaaagaactataatacattttttagccatactttaggagcaacttgatgaaaattagataacaccgtgagacatatctgagtgagaaagagctagaacagaaagttatctctctaacaactcactggtgttttaatggagttaaagtacttcacctacatgcctatgtgaagaacagctaaaaagtgataacactgagttctgtatgttccacattaaatttcattttgctaaacaaaaagcaagtaatgacaaaaatgtatgcattgactatttgttgatataagttgaatctgtcttattactttagatatactttgaatttattttggatctcaagcatgaagtcatagggatgtcatctctatcagtgttttctgaaatctgacatcacagaaaggactaagatgttccaataatagaacatcaagcttttgttgctgcttgtaaattataattcatagaaactttagaacactttataaactttaatttcctggaagcttcctgaattaagtagaaaagaacaatgtccagagtcaatactatttatcacatggacataatttttctcagtaactagaaaatatattgcaacccaaatactatactcatatttagaaaaacaaactctccagttagtagaacataaattactgagatattctaataaagattttattcctatttttaaagccaataaattgagataaatttttatgagttgttaaaactttttaataaaaacaccagcccacacctcaaagcaatttcatacttctgttattagtttctataatagctgtatttataaaaagtacctgcatatgacaaataatatacaagcaatcaactgataatctggtgtgtacacaattcaattcatcaatagttaaatttaatgaagaatctaacttaccggtggatcagcccccttagaaccagccagccctcctgttagggattcgatatcctgaaaaggggagaggtgttgattgtaaagtgctactcaacagcatgaagaatcccccagtcccacagtgtaataatttatttagctgcaaagttagggcatgtcagctattttattatttttttgcaatcttggacactgtagtactatacaaatagtctacatctaaacatctagatattctctccaactctggaagtctataaaaagaaaaacatgtaaacagatttttttaaatatgcagaagtttcatctttgaagagctgaagtgagagcagaaaaaagaaaatttaagaaaacttcagtttaacgtactattttgaaaaatattaaacccatggaaaatgtttaacctaaaaatatttaatttttttttattttttatgaatacataatagttgtacatatttatgacatatgatattttgatgtaagtatttgatgtgtaataatcaaatttaagtccatcacctcaaacatttatcatttcattgttttggaaacgttccaaatatgctcttctggctatcatgaaatatacagtaaattattgttaacaacagtcgccctattgtgctactgaacattatatcttattcattttatctaactgtagataaaaatattaaccaaatcttcttttttcaccacctcccaactagccttcccagtctgtggtaaccaccattctattcactacctccatgagatcatttttttttatagctcttacatatgagtaagaacaggtgacatttatctttttgtgcctggctgattttacctaatattctccaggatcatccatgctgttgcaaattttaaaaattataactatggtctactctatttctacacatagagtataaaaatataaagagatcgatttttaacctttaataggtaaccacagaaggtcatgcttgagtaatgactatagttgttaaatttataaatggggaaataggaaatggtgtgataagctgtagaggctgtgacctgtttatagggacaactacaactcagccctatcagttctaaggctttggttccagggttactaatgattatatgacttattcaaaagaagttgcaattctaggttttaaagtaaaatcacccaggtttttagtgtttgcaactgatttaagttgtaaaccgtccctcatccctcccaaatgaaaaaaacacaactctctgctaaaaggctgctggaaaggagttttgggttaaatcgaatggttacacttcttggctaaaaatgttctttcttatgactctgatcacctcttatctgtttgcatctagttggaaagacagggatgaagaggggggaatatagttgcattaagaaagcaaaaaagaaggataattaagtcccaattgaagtaatggaaatttaaatgcctatgatgaggaaaaaggccaatattttgatataattaagaggacttatgctactaattcacttaggacttaatcagatgattttccccttatattgaaaaagggaggactcttaataatacattatggggctgggatgagcatgtgatggaaacgttcaaggaaggggacagggaaggatggtgttataactgtttctatctgaaatgctaactgtgaaaaggaacataatgggtaatgaatttattcatgcatagtctattaaaggtcacaaatgacaaggagtacttaccaagaaaattattaaatggtctcctttctaatggaaatgtatatatattttttctctacccagaatccttttgagaaactactccttcccctctcccattctagctacaaaagaggctaacaaaaattgcttcaaatattgtagggacctgccagagaattaaggcaatatagaatctgaaaaacataatggtagagtttaagtccttgattgtatcatttgaggaatgtttgaaatgagatgttctctctgcctgcaattcagcttaaaatagatttctggctctgaaaagtaaaaatatcctaattatatcggcattttttgggtctgtttgtaaaaggcccaccctctccatcctgttcaaatgctttattccaacatcatgcccaacataaaaaaaatcaactcatctaaattatctgatcttacatgttctttagcattcttattgtcacttaagtaaattttgtctttgtataattaaaacaaagcatcaaacacatgtataaattgacaaggaatattaatatccttatcaaatccaaagataaaacataacttaaaattgtcttaaaatctcatggaatgaacaacattaggtagtaaaatgactaaaatattagatttacagaaaataaaacacacagcttgcactgtttgataatattctgctatgaccatactgaaaagtttctgttcatgtaaaatgttatttccaattatacttaaaatgaaaaaaagataccaagtgcatttggagttaatacatgtctttctttgtagaaaggcatataagttatattaatgatataaattttaatgaagctatcagagggataatagagaaactgatgtggataacaagtattttagcaatttagtcaatgcattttctcatattttgtaaagtttgatcattaagatttcttatctaagtaagttgtgccaagtttcagatttttaaaattttaagctctttgtgattatcatgtcttgagaaaaaatgagaaagaagaatgtagaagatgaatgaaaagggcaataaattttgtagtttttaacacattgaattcaaaatcaattacgaattcatggctctaaatagtatacagatgtatattcttatctctaaatgggtaagttgtaaattgaatgtaaatcattcaattgtaaaaaaatgtttgagttcatgttctattttgagtgtaagttgaaaaggagtgtcctacttggagagaggtccaagttaaacacggcttatcagttcatgcaaaaggaattttctcaggtgtgcataatgaacataagtgtgcatggatacatttatgttgtaaaataatagataaaacaaatacttgaggaactctggacatatgattactacatagctttcaaatgataactaaaagtgagtcaatatttttgatggttgttgaatattttatctgcaaagtataagtaaaatctttggcaaatgtgtctattttcttatttcaatatattttatatagataacaacaaaaggggacatcaaatagtataaacattgacttcctagaaagttttttgacttactattgtaaaaatattatttgtttaattaaaacactcaaaacatcattttatttttaactaggctacagaatttatttaaccatattgcataccatattgaggtcatcatttgtatctaatagataataaaatagctactactcagtgaacagttgctatgtgccaggtacttttataagtgctttgtagacattaatgccataataaacttatgttagttaattattttctcacttaaaaggttagatagtttacatgactcatacagtatcatagagctattaagaaatgggttataaaacatatacataggactccaaacctgtatttttttaattaccagtcctagtgaacagtttcaccctggtaccctggtgacactgcacatatctatgttggcgatgcaggtaaggctaaaccacaggctggtaaatcttgatggaatatcccgtgactctcccagaacatgacaaaggaggcagtcttatgaggagcttttacatagctatttcttatttgcctccctcacactagtgaggcatgggacttcccacacctcacacctccctacaccaggtccatcttcaggatatcaaactacttaggtgcagtatggaattggctcctacctaacaatacagcccacttctcttgttgcctatcatttgacccatccagttcagtgttgtccagtggaaattgggaccagggtcagaattagagcaggtaagtgaggtgcctatagtgcaaaatttaagtaggtgctggttcttagggtcatacaactgctgacctgcacttgtataatcttgatagtgagcaccttattaaattttgtgccctaagcacctcacttgtctcatctgaatcctggcctttctagggacctgaggagctgaaacaatggtagccttctttatgctgactgtgtaagtaacaaacataaaaccatttggattcatcgtctccttatcactcgaatctgtagaagtgtagcaagcacctacgccatgtggttgctcagggactgcatgctgcttcacactggtatcctcaatcatatgaatttttatcatcaatgctgaatgaaataaactagtatgtattaattatataagaaacttcatttcttaaacatcatttcagataatgaaagcttcattttcctctccaaggtgtgaaaaacctaagtggggttattagccagtccttaacacagctgtgcagattcagtttttcaacactggaaagttctgttcctggcatgaaaacccagtaaaccaaggatggccagtgaatcagaagtcttaaagcttgggaaggttgagctccaggaagagtgaggtgatcagtgtcagagctctaagtagagtgagacttagggcattctcagacttgaggagtctacattgcactgcatttgtaatagtggttgttcgcctgcacctttgctccctggcctcctgcttcaagaattggcatatttttcccttgacaaacactttgaatgatggagctatagggattaataatgtggctctcagtgtaagccatcaagttcagatactgtaagtcttgcttcctttgtgtgcaagtgaaaaaaaaaaaggatattaggatttcaggtctttctcagagctgttgctggattcttatttttatccctgaagagcaggatcagccaattatgttaaagaaaaatatgataaaataatttggctatcgaatacagtaagaatgaacaaataaaattctaaagagttagttgactctcgcatcgcatatcccacaagacccaagagatcttcaaacctgagagttatatttaaagttaatatcaggttttaagctttcacttgttcaaaaagtcacttaatgtaatatgaaaatacttaaaacattataataattgtcaattatgggcattttaaaatttcagatttatgcattgttatgggttaaattatgttccctgaaaattcagatgttgaaatcttaaccctcagtacctaagaatgtaactgtgtttgaatgtaaggtctttaatgaggtgattaagaagattgatccaatatgactggttgtccttataagaagcggaagagatagcagggatgtgtgcacactgagcaaaggccatatgagaacacaagaagaaggcagcaatttctaagccatggagagcaccctcagaagaaataaaatctgcaaacaccttcatcttggaattctagccccagaactgtgagaaaatacatttatattgtttaagtcactcagtctgtggtattttgttacaggagccctagaaaactaatgcatgcatatttgtaatttgggactagtttttagattctttgggaaaagttaacatatttcaatatagagtacataagagttcattaagcagtctataaaaaaagtcagtatcagtggaatcaatgtgaaatagtaaaatgaccatttctgtcaaatggttatatttaaaattatttcaagtctttaaaatatttaatgaagtattatgtatatgttaaaacttgacaaaatttattgtattcaaaatattgaaattaagcatttctctcatctcctttatagaaaaatttctcaaaattcccctctcccactactttctgttgacatgccctattgtgcccaccacatcactgcaactcctcttatcaaggttgccaatgacatcctatcgttcaaatttaatttttcatgttctgtcatcatatttcttgatcgctaagcttcagtcgacacagctgactactccatctttattgaaatacttttcccttttggctttcatttattttcacccgctacatgattttatttagtactgtggctctaaatataatgcatgttgataaattttgaatttctatcttcagcttcaacttatcctctgagatccatactgctacttcaatctccacttagatgtattatagccatgtaaaatgcaataatgcaaaattaaactcttgattccatcacaactcttcccttaaattaggttcccatcccagtgattgccatcttattaaatgacatcaccattcacccagttgctcaggtccaaatccatcagcaaaccccactaagtctattgtaaaaatactacttgaatttgactacatctcattaccttcattcctgtcatcctaatcccttgtactatatcaataatatctatcacataaactgaaaaaaataatatatatatatatatagctttctaactgttgtccatgaatttgttatctccctctcccctatatattctccacatagtagcccaactatccatttaaattttaagttagatcacattgctgtcttgaccaaaaccctaaatggtttcccagcaatcttaaaacaaaacacaaacttattgctatgctctgccatgccctgtatgatttggctcttggctatctctctgactatatcttttgccgttctccctctgtcctgccttctcagacacaatggcgtccttattattccaaaaaatattcaaaatttggcttgtatctcaaggcctttgcccatgcttttcctgcttcttagggtgcttatttctagatgtcctcatccattttgtgttgctataaaggatgacctgaggctcggtaataaaaattaaataaagaaaaaaaaggtttatttggtgcagaattctgaggccagaaagttcaagattggacttctgcatctgagcagggccttaggctgcccccacctatggcagaaggccaaggggagccagctgtgtgaaagagtgaggaggtgccaggctctttgtaacaaccagctctcatgggaactaataaagagagaacccactcacccccaagggagggcattaatctattcatgagggatctgtcccatgacccaaacacctcatagtaggtaccatttccaacattaggtgtcaaatttcaacatgaggtttgaaggggacaaacattaaaaccatagcagtagatatcctcctatttaactcacccacttcattcaggtcttagcataccaaaattctgaatcaccttccaaaactaattatctaaatcagtcaaggttccacctgaacaaactgacaaactcggagactatacagaagaacatttaataaaggtatgatttatagaggtatggatagtttacagggtccagagaaatggtggtacatggggactagcaacagctagacattgcaaccacccttaaacctaaagaaggtgcaagaacaatgtagtcaagagtccagcaagaggtgaatacctatcatcagcctatagaacagcttgccacacagtggagactcaataactacttattgaataatacaattattgaatgaatgatgtgatactatttttacatatataaaaagctgaatctcagagtacatatggtgaagtgtgtcttatttttgtataactgtatcactttgaaagcatggctgaaagcaataatgtttgcacaataaatctttataaaatgcctgagtgaataaactaataaatgacttgccccaaatcacacagctggtgaatgcttgaaagaagctttgaaatcccaagtgttataactccaagcccagcatattttctgttccatcatatatcactaatgagacatcctcctgaaagaaaaactcctcaactctgtattttctcatctcttgaggtactaagtttctatatattacatggtttctagtgcatcagaaggaaaaatgcaaaattatttaatagtcaataaacaatacattaaattcatcctctggttaaatactgccaatgcttccaattaaaggtctgacaccttaatcattgtacaatcaataaatcaatgcttgaaaatttgacctaacatgtatgtctggcattaataaatggttcaaatatgttaaactaaaaatcaataatgtttatttttatgtaacatctcatagtgtgttggttcacagcactgggaataagtaatagaagataaaatttattttaaacaaatcattcactttttcacacaaggcttaatggaaacaacctttcatcaccgaataccagctccttaaggcaagcatccaaataatgaagctgagtttgttaatgaggcatcttcctcctcaaccagacttaagcagttagtgtttccttgacaacattatagggtaaatttcctgggaggcatagaataagcaggaaacatacagaccaattttataaatttttcctatgtaagccaaaaggtgtcctttttaattattctttaaaacaaaaaaaggggaaatatctctttctttactttgagtataggccagcctgaatctgaattttccttaagccacacaattaattccttcaaaaaagagcagttgagcaaattttgtggctgaggcactgtactcttcatgggaggacacaatgaggagtaaatcaaggtcacaggtttcatagtattcagagtcatgacatgctctctgactttaaggatttttcagtccaaaagcacataaatctgcagaacaacatgaggaagaattttgagaaatgtggtgttaaaattataacagacaggggttgtggtgttaaattttatagtgtgacaattagtttgggtatttcatattgccagattgtactttatttttgaatgcatattgggtaagtgtctccaggaactggttgagtaacataataattaacatttattaagcatttactgaaacacacaccatgctaagagctctactgccgcattaggtaacatcgtaactctcttagccattattatttccaccatttcaagatgatgaaactgggtctttcagagtttaaatgacttaacaaaggtcacacagccaataagtattcaaaccaaagaggctgattccagaggcaatgatttttaacaatgatgctctcttgaatgaattgaggtatgagaaaagagtagggagaacttcttggcatgcatatggtgacttggaaaaaaacataaatacttattcactatctgaagaagaaatgcaacaaattgcaggcagaataattctgaggtggctgatatcctctgatgggaggatgattatccttgattgacctgtaaatgtaagagctgagaacatcagatttagccaaaaagtaaaattcccaaaatcttggctatatatttctaatttcaaagtcttctacctgaattcaaacctaactaggaaatataatgtgtatcaaaggcacaagtgtttcaatagtgcataagaatagggctttctgaagaaagtgccagagattcaggttctacattttccacttcataaattttgtgtgtcgctttttcttgtccattcctttccatatggctgaggcgataaagggaatgttttgctaattcctgactcagtctcaatcaatttctgttttccaacttttccacactgatgcatccttgctatctcaaactcactatatccaaataagacatcatcttctttatcagccattgccatggccaaccgccaatttcctattcctgttgatgttttcaataagcagttagttatccagtctaggtttatggatgttaatagagttttcccttactctggtatgcatattccaatccagtctagttttccttgtaaatatctgcttagttgattgccttctttcatttaccattgcatttaccagcttagttcaaaacctcattttattttcccctgacccctggctttttccaaaacagtgtctttgttgagttcctttttccactctcactttcatatcatcttttcttccaaccagttcccaaagtgtggcctgaggaccaccaccagcagcagcagcaacatcacctaggaactcataagacatgcaatttcttgggccctacctgaattcggctgcatctgaaactgtttaacacaccctccaagtgagtctgatgcaggctaaggttggagaaccactaccccagagtgatgtattttaaatgcaaatatagacaggttacttctgtactcaaaatacttaagtaaggtccccattcccaggaaggaaagataatcaaacctctgtacatgtggttttccattgtcatcatacatttctgaactacttttttcacttcaccttttaccactttccaaaaaagaaaccctgcactcttatcataatgaatcctgcacttccttattgtgacaagtgttttcttttatgtttctgcaccacggattcttatgtctagaaagccacccctaccttgtgggtgaatgtaattcatcctttgaaactcagtctaggcaccatctcctctggggaggctttcctgagtccctcagaccgaagggagggttctactctagcacaacagaggtactgtcccaagaaactttgcctgaggggtagtcaacagctctccaattttacttcaagcctgcaaaatgtaagacacatgcaaaaatagacagcttagtgatccagagaacaggttcaagcctggctttactacctactatctgtgtgaccttaggctaattgctttatgttctttacagaaaataaatcaatctatgtcctagtacacaaattagaaaggtttggaatatttattataataattaatattaattttaataattcatggaaagctacctattgataacttacagtaaacaatattaattattattattcatgtaataatacataggtacagtctagttacacatgtgtaaaataaagataggctatggatacagattacataaagatatatgttaaaacagataagcattagaatacatgtaaataagacccaaatatagactaatcttaggtataaatctccattagatttctagagattattttgcctgaaagggaaggaaacctaagattcattttatttccccacatagtcttacaacttttatgcatttctatggctttggttattaaacatttttcaccagtcatattaaagcatattattttcattcttcctaataaaaaaatgagtaatctttttgctgtacattaaaaactatgtattgggtaacatgtataccataaacccatacaaatttattcctctttaaatgtgttatttgatatcacaggtttatataccatgatgtgggaagctttaagtaggttagaaatgtgctatagccactgagaagaagaattcaacatttaaatgagaatatcaatattataatcctagatacacataatttatgggagactcacttttgtttgatggatcggaggctcaattactgtaattctaatttataattaagtcttcaattacatgatgcttagatcttctcctatctgacacaaaatgcaaacaaataactagaaaaatataataccacataatttaattttaaaaatcaggttttattttcaactcagtaaatagtagcctaaaatactggcttaaaaaaaaaaaacttggagattagcctatcggaagtgatttttgtaagagggaagaataaaatactgtcttttccaactgttaataactgcagttcctctgactgtggtaccttaaggcaatttatcagtctgattcataaataaccacaaggcagaattttttgtgaactgaaagcaaaaacagggcaagtggtttattaaatatatatatatatatatatatctgcttttaaaatagatacttctaataatagatatttctaatacatatttatttaaccgtatctctcccttactggaatttaggtattaagccaattaatataaacagtttcaaggtaatcataataagctggcaagaaaacagatgatctatattcaaattcaagttcacacttctagaaaaaattggcataggattttcagctgaatattaagtattttatggtcatatattaattttggaagtaatagccttggaggaattagatagagctagggggagagatgagatcttaaatttaaaaaaaaacagcaattagcaacactatccaaaatcagatatgcaaaatttgtgaaaggaagtctaatttggaacctaagaaacatgcagaaaaattccctttgcattgctgttttctttgggaaagaaattcaccaagttctaaatcataataagttaatttcaaatttattttttattttttagttcagtttttgaaataagtgatgatcataatgttaacaagaaatagcaaaagaacatatgatttatctatttttcttctgggcagctccatttcaattgatgctaccaggattctattatgaataaatgtttataataccaaataatactattgaatggaaatgtaactgactgatatcagagcataaaatgcattgatgttatgttattcaagtaattgagactatagcataatgtaggagttgtagagcacagcatagagctggagatttagagtcgatcatagaacattctatagtcattaaatgttctacagacagtcttgttctccttttcatccactcaagctccccctccccaaaatacaactaaaataaagctttaaagtttataatattctttcatttactgggatcaatttagaatattttatatccttatctctcctttccttaatatttctaggacatatttttcattacttatacttcctcccaaatgtaactgacagcattcaaatgagccacaccaccaggtaagaatttcaaagtgcatacaatgctaagttccttggggttagtgcagtggcaaagtctggatatttcttttgtttgagagcaatcaaaacagacgatacagacagtccttacttggcacagtacagtgttaactgtctttaccttgcatggctccatgaaatcagttactataaagcagggacatggctcccctggttctggtatgtactggtttcagtaaacacagtacagtaccactcaaagcaagaatatagtggcattttaatggcagataaatcttcatccctttgcctccagcataccttaaactggattgtgaatcttgaatgcatagtgcagtggctatgtaacacaatattaaaattggaatctttctcaattttagctttggtccaaaggccaaaaataatgtggtgatgaccagtatttccatatccttaagcaaggagctacatcaagccatgtgaaaatattgtaaaacagattctgccagaattgataaacattgtctcttaatgagagcattattggcaaattaggcaggaaatttcttcatggaaagtatactgaatttgaatttcaggatttttcgcatctttacacttaggcaccaaagtctattcctgtctcactcctcaccctcccactcctcctcccccaacacacagaggtgactattcctgaggaccagatttgagctgcagagtgggcagtgcatcttaaagtgcttgacctaagaggactgctagaaaagtaaagcaacgtggcccatgggtaaactactaaattccattccatgtgaagagtatattaatttcctattgcttctgtaatgaatttccacaaattagtgacttaaaataacacaaatttattatttcacagatttgaaggttagaatctaaaaatcaaggtgttggcaggggctatgttccttctgcagacttcagaggagaatccatttccttgccttatccagcttttaaaggctgcatgcattttttggcttatggcctcttcctccatcttcaaagagcattatttcaatctctagttctatgttcacatctctttttctaacactaacccttttgcctccttcttataaggactcttacattggatgcacctagctaattcagaattctctctccatctcaagattcttaaccgacctaatgttctcacacccacaatgtcccaaaggtaacatagccacatgtcctgggatataagatgcagacattttgggggttccttatgcagcctaccacaaggggtaattaaaaatgtaagttagaacaggcttggcctgaatgtaagaataccttggattcaaaccaaattaaactttcttgaccagcccaggcaggagtgacctctccatccactgaacttccattatacttattttcatctatatattgcctgatattatcattctatgtgttttctttccacataaatcctaactctcttagcataggtttatccatacctctctatattctgtaatgtttcaataaatatgttgattcgagaaaaataaatggaaagacagtttcagtgggcagtttcctgtgtgtgggaggactctgccttaaagtatcctctttcagtacctgaaattccttttattatatactgctttctgttctgtggcattgaatgctcaggcacaatgacaagataacaccttattggaattagtcaccaatactaagtgaatcatttcaacagattttgcctgaacctccactgcaaactcattaggaggaagtatattaagttagtcattcttttattgtacagattgcatttgccaagtgtctttcacataagattaattcaacaaggacctattaatggataatagttagctaaaagcaaactttaattagctgtggaaaggagataagtaacttttgaccaggggaaacaccaagaaacagtatttagcaaggaagaaattgtccaaaagagaaagaagaaaaagataaattttattttataatattctttagaatgtctttggaaattgtgataggaagactctaaaatggttcctagtgatttctacctcctggtattcacacccttgtgtaatccccctctcttacatgtagatgtttaggcctagtaaaaatatggttaagtgttgggatgtcttcttgtctctcctgtgattaggttactatagactgactttctctcttcctctctctctctctctgacacacacacacatacacaaacacagacacacacacacacacacacacacaaaacctgtctgggggaagttgccacactgtacagcttatgggaagatcaaggtagcaagaaactgatgtctcatgccaaccactagccaggaaaggaagcttgccaagctcaggttaagtgaattcagaagttgctcctcccacagtttgagcctgagctgatgtcagccctagctgatactttgattgcagccttgtgagagatctggagtctgaggacccagctaaaccgtgccaaattcctacccacagatattatgaaataatataaattgttttaagccagtaagtgttcaggtaattatttacacaggaataaataactaattttagagtcaatattcatatatttctaatctgttattgagttttctatgttcaccatacaagtgctcattataaaataaaaatattttacaggttgaatctttttagaccaatgaatccataaaagaaataagcaattttcttcctctggattttatggtctggtattataattctaattacacttcgaaaagcaaagcgatgttagaaaaacaataataaatgatcattcaattgattgatgttgacaactatcaatatgaatcataaaattgtacacataacttgtactgtatctgcttccacacatattttcatagtattggtcaattttgaatgtataacaatcattaaatttctaagaaaaacatttttgtggtgataaattctaggtggagttttgataccctaaagccatataactatcaataaagatataaaattctatgacgaaaaagcagttatttttaattatttataaatagcttggcctagttgacaataatgtttaaaaagcaactaatttttagttgctgaatatatcatcacagtagatgatttatacttttttaaacctgaaatactttctaacataagtactccttagtcaatatctctgaccacataatgaaaatatctatccaactcatttttacctagtgttttggaataaatgaggcagtttaagtctcttttcaggaagcattataaagtgtataagagataatatgatatagtcttatatatcataaggttagatgtttgtccccacccaaatctcatgtcgaattttaatccccagtgttggaggtggggtctggtgggtggtgtttggatcatgggggcagatccctcataactcggtgatgtcttggtaatagtgagttctcatgagatctgctcatcaaagagtgtgtggaacctcccctctaactttcttttggttgctcctgctttcaccgtgtgatgtccctgttcccccttcacttcccaccatgactgaaagctctctgaggcttctccagaagccaagcagatgcccacaccatgctccttgtaaagcctgcagaactgtaagccaatttaaattacccagtctcatatatttctttgtagcaatgcaagaatggcctaatacagaaaattggtaccaggagtttggggcactgctataaaaatacctaaaaatgtggaagtgactgtgtaactgggtaacgggcagaggttggaagagtttggagggctcagaagaatacaaagagataagggaaagtttggaacttcttagagactggttaaatggctgtgactaaaatgctaatagtaatatggatggtaaggtccaggtgtcaaggtcttagatggaaatgaggaacttacaggaactggagcaaagtttacacatgttatgccttagcaaagatcttggctgcattctgttcctactatagggatctgtggaagtttaaactaaagagtgatgattagggtatttgatgaaagaaatttctaattaacaaagtgttcaagatgtggtctggctacttttaatagcctatgttcagatacaggggcaaaaaaaaatgacctaagattggaatttatgtttaaaaaaacaatgcataaagtttggaaaatccataccctggccatgtgatagagaaagaaaagagtttttatttttccaggagagaaattcaaggaggctgaagagcaaccacttgctagagaaatttgcataactaaaagggacccaagtgctgatagccaagacaatggaaaaaggcctcaaaagcatttcagaaaactgtgtggcagcccctcacatccatcacaggcctggagacctaggaagaaagaatggtttcatgggccagacctggggccaccactgtcctgtgcagccttcttggcatcctggttgctcctgctccagccttggatcaaagggttccagatactgctagtgctgccagatactgatagtgcaaaagccactgaaagccttggtggcttccatgtggtgttaagcctgtaggtgtacagagtacaggagtgaatgaggtttggtgctatctgcctagattgcagaggatgtattgaatagcctcagtgcccaggcaaaagcctgctgcaggggcagagtccccacagagagcctctcctagggaagctccaatgggaaaagttggattggagcccccacacaggttccccatgagggcactgcatagtgaagctatgagagagaggctaccaccctccagatcagagaactgtagatccaccagcagcttgcaacctgtgcctggagaagccacaggcattcaacaacctgtgagagcagcctggtgcttaactttgcaaagacacagaagtggagctttccaaggccttgggagtccaccccttgcaccagtttgccctggatatgggatacggaataaagattatttgggagctttaaaatttaatgactatcctctttggtttcataattgcatgaggtctacagcccctttcttttggctaatttctccttattggagtatgtttgcctaatgcctataactgcattgaatcttggaaataactaatttgttttttatttttcaggctcataggtggaagggaattgctttatctctgctgagactttgaacttttgagtttacactggaattagttaaaaatttgagggacttttgagaaggcatgattgtattttgcaatgtgagaaggacatgagatttgggaggggccagcagtaaaatgatatagtttgaatatttgtccccaccctacttttatgtggaattgtagtcccagtgctgaagatagggcctggtggaaggtgtctggatcataggagcatatccttcatggcttgatggtgtctttgtggtagtaagctcttgcgagatctggtcatttaaaatgtggcacctccctatcccctcttgcttgctcctacttttgccatgtgatatgcctgttcccccttcaccttctgccatgattgaaagctccctgaggcttcttcagaagccaagcaaatgccagcaccatgcttcctgtaaaacctacaaaactgtgagccaattaaactttttttctttgtaaattacccagccaggtatttctttgcagcaatgcaaaaatggcctaatacaagatactttttaaaaaaacaatataaattatttcccttttcataagcatttgcaaatgattcagccttactctgttcagaaaaacaccagccaaaaaataaaaatatagtttcattagcaaacttttctgctcaaatgatcatctctatacagcaattgtttttggcttcttctgaatgtttttgcactttatatttcccaactctggtttcctttggcaattccctgacctcatttcttaattctcagtgctatgttatataattgtctgaataagcagtatccccccaaaatgagacaaatttattgagaattttgcaatcagaaaatcagcaaaaaggctaatttaatattaacatattgtgatttttgtgtggtgtaattgagtgttggtattaatacaagagctttaggcctaggatgcctggatttgaatattggctctgacactgtacagatgtgtaaccttgggctagttacttaagagttttgtgttttaatttcccacatataaaacttacgtaacaatagtacctgcctctgatgattcttgggaaggtaaatgtgtacacacagcaaatgcaaataagggttaagtggcagtagcacaaatagcaatagtagcagcagtagtagacagtgaaatactgacttgatgtgctttgtttaaattttgatttgcacattggcaggaggataaatctggtcttgtcaattcctctactgggtctgtggctgcaggctcttaactctcatcatccagtcatgaagaatgtggtagcataatttcatcaggaagtattgggacccagtgaagggtgaggaaaaagactgacatattgcatatttgcatatttaaaccttgcatatttaatttacacacttatgaaggaacctagtcttgcttatgaagcaaagacataagccaagtttaacaaatctgacaatatttttacagatcgaatggggacctcattgaacagggtctcttatactcatcctgtgcataatggcctcagcgaaactttttctttattaaacatactgctatgttttcagttgttcatactttgcttttgattgagcagtttattaagatatgtgatgaattcttcacccagtaaaggaattaaagattatttgacacttccttggtgataggcagaaaataagttaacctattaaaatgcaatccaattagtcttgacctatatgatcccccgctactagatgaaaagatattctctgatccttaaaccttatgcacttgaaaagaaatagagtcctaccttttgaccttaatttcttttctcttgagaaataggtttttttgacatgtgaagttagagaatattaatcttaaactcaggtttgttatgagtctagaagcttctttgtcattgttgaaatgaatcatagacagacaatgcctaatgagagaaatggcaggattactagaaaatgtagatctccctgaatttctaaattttgcttaattaatatgtttaaaatgtataatgaattaagcataaaaagtaaaacatctttcccattctctttcaattgaaaggaattatcagaaagtgtatacactccaagtgacatatttctcagtaaatcttttttaggccctttaggctattctgattcattaaatgtcacacagtatgagaaattacataaattatgatacattatttaaaaacttatttagagactaaaattaagtattctatttataattcttttcctttgcaataactatcagctcagactggataagtatatctaattaatctgaggaaggaaaggggaaaaagccatggaaattaagtaagtcacatttaagattattaaagttttataagccacttcagctaaaaaatctatacaggaatatgtcaaactatttgatttagatttacattattcagagcaagacaattcaaattctttagtaataacattcgtccagaaactacaagatagcatagttttccttagtaaactgaaaatcaatcagtagaaaaacttttccaaaatgttacaaatgctcccatatgtctgtctccttcactatttagaacatttcctctagaccaagactttgctttgttcactggtctatttccaggcacctggatcaatcagtgtctgcatatgataggctctctctcaataagtagagttgaatgcctagatgaatatactatttcaattcaagtcaggctagaatgatcaatcaaggaaatatccaacattaatttttaagaaaacaaactagatatcatgtttggaacctgaatgcagtaatactatagccaatgtgataagaataatcctatacagacacatttgttgagcaatatttttaaagaagccacttaaaatgtagtaatataaatgtcaccatggatataagtattcaagaacagaaacattaaggtgacaaaagtaaagattccaagacttactctgagaatttctgattcgataggccaggagttgaaaaactttgtttctaagaaagaagatttattcatgtagaattgctatgagttgaatgtcccctccaaaactcatgttgaaatgtaattaccattgtgatggtgttaagaggtgggacccttatgaggtagtaaaaccatgagggttttgtcctcataaatgaattagtgctgttattgcagaagcaagtttctgataaaagtgagtttagccccctcatgctctcactcttaaacatgctttcttgcccttctaccttccaccatgagatgacacagcaagaaggccctagccagatgaggaccccttgactttggatttcctagcctccagaactgtaaaaaataaatttcccttatttataaattagcctgtgttatgctgttatcacagcacaaaatgaacttaagagaagaatggttgtgaataaagagccagaggaaagaacatgaagaattagaagtgtcaggaaataaatattttgtttatcatttgaagtaaaccctttgttgcaaatgagtttgcatatattttggccattccctatgcctgtggaagaagggtaggtatgagatgcacagtttagaagtgttactaatttcaacctatctagtcctttatacacacacacacacacacaccacaaacacacacatctagtggaaacaaaaaggttcattgatttttctcctttaaagtagtggttttgagtagactgtatatgagttatctattgtatgttccatgacaattaacatttgttgtaataaaatgcattttagcaaaacagactttattataagcgttggtagagctaagatttttactatctatgagtagctttgaaagcagacatttctactaactcagaaaagccttagatcacatatttcactatcaagtaatatgcagaattaggccatgcatctattataaaaccacagaaaaattttagaaataaaacattataggattaaagaaattgtaagaaattactaaaggagatatagagagtatagcacatttcatgtgatctactcatgtcctcaaacattagtaaaagataaaacaagatgactttaatggtgacttaaaattgatttgtttctataggggtttaaaagtttgatagtgttgagtaaagactttactctggtaaacattataccaaattattttgataaatatattaatacatcaaaagcatttttaaattttcatgatttcaatattgtacaatttttgcagagatatttgcttcttagtataaaggttttttcaccatttatcataaaaattttatgtaaccaaaattatgtagtggtaaaattgctttcttcatagtcatagtaatattataagctcttattgaagacatataaacataaaataataatatcctctctaaaacaaaaaaaaaatagcttctttcttgactatttgaattatatttaggttagttaagtataatctaaatgaaagaaaaaacaaattattgcattctaagattatgccataaacctaaatgtttgcttttagtggatttcatcaccatggttgatctctatcatataatattaagcaatttcaattattctctctgaatacacatgtcttaaccctgaatcatcctccaagtatcttcctatctctctagtccatgtagaactaaaagagtaatacacatttatctttctccatatctaacttattcaattcctaacctgtctctgcatccacatttctattgaatcttattttgccaagagtaaaataaccttaatatattgctaaataaaattcttactggatgttcatagtacataatatagttgactcttcaatccttgaaattttaacccatgaaacttgtcttcatctttcatgaaaatattggactttcccatatcctatgaccatttgtcttcatactgcttcatggatgcctcttcacctgagctcccctgaaatggtggtgttcttcagtttaatccttgaccatatatcttcatactctgtaatccttttggatgatctcatccattcacagagtcataatcactagcaatgatatatactgatgatggctaaacctttatctcttctagtgtttattttcactgagacacataaaatataatgttatatataaaatatgtaaatgaaaatatttttaaattagttactaatcaaatgcagagttctacaactgtatgtctacagctttcaaattaaaaaacaaaacttaaaattcccattctcatgctttataaagatttttgtctaccaaatataaaatctgtcataacatgcagaaaattaaatgatgaattataagaataaaatatggaacctggaaaccctctctgaccagaataggtttggtttttgttttgttttaacaaattccaaagcatatggttctgggaaatgtgtttccaaacaattttctagcattatttaaagattactagttccacttctggcattgtgcactatgtctgaatttatacattgactgcatacagtgtttagaaggataaaaaaataaaatgataaccaaaaattatcacagaaatattccagagaacagttaccaaaaaagactatggagaaaacaaaaaccaaaataactaacatcggttggatatacatattgattagttggatataaataaatcagttggttataaaattgagtgaaaataaaaattttgtgtggagataaactttactaagaatgctcatagtttaaatttcttttatttatatactataaaaattatttttaatgtcactgacaagttgcacccaaatttggattaaaaggtttggaagataaagaagaaacaaaccatggagaagtgagtaaattcggtaagaactttgaataagtaaaggtatacaagattttaagactgacagcttgggttccagaatgaaacggcttccttctgcacatacaggttatatggcaaattagcctctgtgaactgcattttctcatctgtgagatgcaggccatcatggtgcacaatacaaaggattgttggaaagattaaatgaaatgttacagtgcttgacatttagtcatcattcagcaaatgtcacctataactaagtgtagctgctgtaactgctgctattactgctcattacaggtgggaagttgacctgctgcctccatattagggctggggtcaaactgattcatgcatttagagagagttatgagggtaccatcttgaagaaaccacacaatgttggaacactgttaatacatccatccacataattttgatccctgagacaagaagaatttatggggttagaggcagtagaatttaggggttagagcctgggctttgtgtcaggctacttgggctcaaatcacggctctgaaactttctaaatgcattatcttaattaagttatgtaacctctttatttatctgtaaaatgaagataaaaattataactgactaaatgggttgtgaaatttaaaaagcacattttatataaatcactagatagtttatgagacatagtgctcaataaataaatatcaatcagtgcctaatattctactattctttctgtcagtatgttgtaaaaaatagtaatacagttctccattaaaactatacaaataaagcttattatttgtgtttcatttcgtcagtcacacaactgttctgatgaaccccgaactgaactctttgtctcatttaaatcaacccataagagtaaactatacactttatgggaagactaaaaaaaaaaaaaaaaaaaaagtaagaagaaagtggctgcaacttagatttacaagatttaagtaagtgaggaaagagaaagagaaacaacaggaagctgaagactggaaaaagtgagagaaaatgtgggatgtaagctggcatttcttatcacttgctcctagcagctggctgctggagaggagtaagaaaaacagggcagccagcaaacacccagggcataagttctcattctgagacctacccccaccatcaatgacactgtggctgcttgtatctagtgccacagcacagattatgctgatgtagttccacacatgcatcccttcagtacacaaatgtgttgtagcacttcccagtctaaatgtgtcttttcttggtccattttctttccccagttactataaatttttctattgccattgactgccaaatttttaatgttgtcttcactagtttctccactatattacccacttcgctctgacctagctttaaatcccatcactccagtgaaatcaatcttgtctatatcaccaaattattttaatccacttcattaaatgtcagtagcaattactgaagttgtctacactctatttgtcaaaacagtggcgttgatgatcacagtaaggattgtgggttttaattaaaatgtacagaaagccactgaaaggattttggcaggggaagcctccaatgacactaggctctttgggctttattcttacttctctggtttctccttgtcaaacaaaattctaaattccagttgttatagactaaatgctgtgtgccctaaaaattcatattttgaacccctaaatcccaatgcgatcatattagaagacagagtgttttggaggtaattaggtttagatatgattatgagggtgaagcccctattatcaaactagtgcccatataaaacaggaaagtggcactggagcttcttccctcccccgtgtgaggacacaccaagaaggcaactatctgcaagccagaaagagagcttttaccaagaaccaaatctaccagcctttaatcttggacttcccagcctctagaattatgagcaacaaatgtctgttgtttaagccacctggtctgtggtattttgttacagcagcacaagtagactaagacgccggtgttccccagagttcagtccacagacctcttctcttttttctctacacttcttcttgaggggtttctacccagtttcataaccttattaaaggctacttactgtcaatgagtttcatatttgtacttttgcaaattctcctctgagctacagatttttatagcaatctgtttatcagacatcttattagacatctcacagacacctcatactaaataagtttaaaatttctcttttttacagccccaattttttctccttcttagacttctctatctgaaaaaatcattccaacaaaaccagaaaaactgctagtcatccttgatttttattcttcctcaatccccaagtcctatcccttaagtagtcctatcaatccaatgtacagaatccaatgtatagcatcttcttttcatcactactgctgctcaactgtaccaacccactaacttgtaacagaaaaactaaaatatgtccctcactgttatcacattcaccctcttgccctccttctccacttgcttcagcagacttctctgctagtatggatcatgcccttcattactccatacttttgaaataaagcccaatttccttattgtggcctaaaaatcccaccataatcccgtgccttggctacacctcacctccacctcacctcactcatggctctgacgagctcactgagtccctagatgcaccgagcatcttcctaatgccactgtgtaccaagctgtgtcttacatatgatactctttctctctggaacgctctttcttctgctcttcgtaaggcaattgtttattaatccttcagacctcagcttaaatgttgcctactcacagagtccttgttcacttcaagtatcttgatttgacttattattctattcctcaaccatttgttccttcattgaattaagataaaattattttatacctatttgttgtttacctgtttgttgtttgtatttctgctaacacaaataacacagacataggatcttgtctcttgtattcactaagggatgcttagttctagtacatttcctggactttgcagcactcaatatgtgaaatgaatgaactcaagaatgaaagagacattcaatgtacacttaaatagtgaagtagggtgtgcaaattataacattaaacaggttaaactgtgttgttgtgtagtagagtttcaatattaaacataattgtcatccaaaaatattatagctcaattaacaagtatttattgaacccagtacctattctgtgcccaaaatactgcctggtgttatgaagaaggttgagtaaaaaataaaatggtcactgattttaaaggttataatattttagaggagctaaggtataaacacacaaaacaacttgaaaaggatatataaaatgacttcatgatgagaaaaacacctgtgaaatatgtaataaaacttaatgatagcaaatgaaacttgtctttgatgggagtgacctcaaacacccaaggcccttcagaaagggagcatcaatgagaacagataaaataaaagacaagtgcagacttcactaaaataggaaaattaaattacccatatacttgcacatacaaggttcatttgccttgggaagttttaatacccacaattctgaatttttctataagttatattaaaaagccaagggacattacttgaggatagcaacttaaatataatatataaatatttattaagaacctatcttgtgggctgggcacggtggctcatacctgtaatcccagcactttgggaggccgaggcaggtggatcacctgaggtcaggagtttgagaccagcctgaccaacatggtgaaatcctgtctctactaaaaatacaaaaattagctgggcatggtggcacatgcctgtaatcccagctacttgggaggcggaggcaggagagtcatttgaacctgggaggcagaggttgcagtgagccaagattgtgtcattgcactccaacctgggcaacaagagtgaaactctgtctaaaaaaaaaaaaaaaaaaaaaaaaaaaagaacccatcttctgtccagcctctacctggtgtattgttacaaaaatgaaagatacggccgggcgcagtggctcactcctataatcccagcagtttgggaggccgaggcgggcagatcacgaggtcaggagatcgagactatcctatcctggccaacacggtgaaaccccatctctactaaagaatacaaaaaaattagctgggcttggtggtgggcgcctgtaatcccagctacagaggaggctgaggcaggagaatggcatgaacctgggaggcggagcttgcagtgagctgagattgcaccactgcactccagcctggggtgacagaacaagactaggtctcaaaaaaaaaaaaaaaaaagaaaagaaaagaaaaggaagatacagtacctactcacagagtgtccatagtccagttggagggagaaggaaggaagataatcctatgaacctcaaatcaatatacattgcaacaggtggtatgtaaaagatacaagcacaatatctcagtgaattaatacaatagattcttggggagtaaagattttctccacacagagccaaagacccttactgaaaggtaaaaatgcaaaaactcaaaccaaacaaggtgattcagttgattattttgtcatgatgcatgactgtctcatcagccagttgaattttccactgtagtaatcatttttactgaaaaataggttctcttttgtagaaactgtagtttataggaaatcatttgagtcacacattaagtcatgttctaaagtttcagtgtccaattcagcagctactagtcacagataggtatttagcacttgaaatgtggctatttgccacgtgttaaaatgatattttggatatattgatttaaacaaaaatatactattaaaagtatttttttatttatttttcttatttcaaaatgggacttttcaaaaatttgaaactgcatgtgtatctcacattgtatttctactgggcaatgctgctctaaaaagtttatgaaacaagttaatactatttttcaggaataggatgggaccaacttagaagattagacattgtccaatacggagtttgcaaaattctttctaaaacaatatgtaatataaataaggaagcataaaagtttaacactatgtactgcataagtattgtcttatccatgtgggaaagcactgagcacttttaaaaatatggttccatctagggaggctatattacatattttcaattaaatttgaaatgcatttacagtattgtgctactgtagcagagaacttcataactatctttactgttacttttatgaagctatttattgtgctacttttgttgcttccacaaccttaaaaattatacaaaaatgcatatattttttatttatgtataatactttccatttgaattcattgatttctaatagaacttttttataagttaaagctaaagagaaaagtctaaataaacatcaggtagaaatgtatagtaatacccggccgtgtgaggtgtcagtctgcccctaccggggggtgcctcccagttaggctgctcaggggtcaggggtcagggacccacttgaagaggcagcccgcatagccaagacaatcctaagccaaaagaacaaagctggaggcatcctgacttcaaactatactacaaggctacagtaaccaaaacagcatggtactggtaccaaaacagagatacagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaatcataaaaaccctagaaaaaaacctaggcattaccattcaggacataggcacgggaaaggacttcatgtctaaaacaccaaaagcaatggcaacaaaagccaaaattgacaaatgggatctaattaaactaaagagtttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcgaaggacatgaacagtcacttctcagaagaagacatttatgcagccaaaaaacacatgaaaaaatgctcaccatcactggccatcagagcaatgcaaatcaaagccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccgtttgacccagccatcccattactgggtatatacccaaaggactataaatcatgctgctataaagacacatgcacacgtatgtttattgcggcactattcacaatagcaaagacttggaaccaatccaaatatccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatcacatattctcactcataggtgggaattgaacaatgacaacacatggacgcaggaaggggaacatcacactctggggactgttgtggggtggggggaggggggagggatagcattgggagatatacctaatgctagatgacgagttagtgggtgcagcgcaccagcatgtcacatgtatacatatgtaactaacctgcatattgtgcacatgtaccctaaaacttaaagtataataataaaaaaacaaaaaaaatggaaatttaacaaaatagaaaaaaaaagaaatgtatagtaataatatacattgtgtttatttttatgtttttaattggaagaaaaattttaaaaacagagggtggtatataatttaaaaccaaattgaaaatggcttcagatgttcagcatctatttgtaaaccaaactaaagatatggagactcatccaccaattattgtaaaattttaaagaatgaaattagaatttacttttaacttagtgaacctcatgcaaaaagttttcttaagttattttgaaaaaaaagtattacttgtaaaagaattataactgagatttatgtagctgagttaacatgaagcaatagtgacatgcaatagcattaaactaagtggatagttacactagttctgtgaagtgtcttaaaactgattgttactatctactttgtttagggaatctctgttaatataagagactcagtttacaaccttcttcaaatgattaggaataacacagctgttaaaatgcatgagattacactgtaatagcattctttacctaataacaaatcaggccacaaatactaatgaacataatcactgggcccttaatggaagatgtctgctaattttgaaagctttacaattagctgtgattcaatgaacctgaatccatgttaaattaaactgttagggaagacaaaacagtgttgtttcaggcaggcaatgctaaaggttctaactgaattttctcaaggcaaggtaattttaaagataaaattgttctcttcttttgttactgtaaaagtgaagctctgcttcatttataaattgtactcagattaaaaacccccttttattttattttttaaattaataacctaccagagccatcggactgccaatgtttcaaaccttctctctcatctttcttattgttcaggttcctcacatagggcttctttctgcccagctctgcaagcctattccagccttagaatccttacccttgctgttccctcttcctagaaggctctgctccttgctcctctcataaatggctccttttcatttaagtctcagttcaaagacagcattccagagttttcttttaaagtgctcaccacttcccctaatgtaggaagggaattattcctttctttttgtcagatccatcatcaaattttgatttattttgttaatttttttgcttgtttattgttggattttccattatggaaactacactccatgagagcataaaccattatttagataataactgccataaacaaactaccattaacaaatggttggtacacacacacacacgcatgcataccacacatacacacacacatagactcacaaataaatatatttgtaaatatgtcatatatattttacaaagttaatttttttgctatttgctagcaaggttttttctattaaaaatatattatgagagctttcaaagtcaataagcagatccctgtagcaaatttataacagctatagggtgttccaccatttcagtacactagattatcaaatctcctgtgttgaatacttatattagcaccatacttttttactactataaatagtagtttgtctcttattttttaaatagatatttttcacttgcctgattgttttctcaggataaatccctgtaaattaaattgctaaataaataagaatatacatattttaaattatggctcatattgccatactgtcttcccaaaatattttaccagtttcttcttaaataaacattatataaatcttggccatattgaaattatgaatacttgccaattcaataggggataatatataatttcttttttaataaattatggcctttgcctattcttctactggaaagtttattttttgttgatttctaagatctattcacatattaagactttaatatctatagtaaaattactctcagttataaatacttttccaatatttatatgtattttatatatcttggggcatatatctttagttgctttacagtaaaatctgttttcccttcaggatttttgagtttagtattaactttaaaaatgggcaccttccacccaagactatgaaaattgcacactctctctcacacacacacacatacacacacacaatgtacatctaatacttatcacacatgtacatgctatatattgtatttataaaatattttatatttccaaaaactgttgtaatgttttagatttaaatatttaatcaagaagttttaaattttgtttaatcaacatgtaataattacagtgacatgtaaatgatgtacagtataatacatgcaggtataaatatagtttgagtatttcttatctgaaatgcttaaaatcagaagtgtttcagattgagtattttttaggattttggaatatttacatatacataatgagatatctgtgatcagcacccaagtctaaacacaaaattcatttatgtttcatatacatcttatacacatagaactgagatattttcatataatattttaaataattttatgcatgaaacaaagttttgactgtgttttgactgcaacctgtcacatgaggtcaggtatggaatttttcacttgtgacatcagtcagcactcaaaaagttttgggtgttggagcatttgggatttcagaattgcacattagctatgctcaatctgtatgtatatccacctgaattttctttaaacactactaaggttttgctacttagaagtaaaatctttggtcaagcacagtgcctcacacctgaaatcccagctctttgggaggccgagaagagaaccacttgagcccaggagttcaagaccagcttggaaacatagagagacctcttcaccattaaaaatcaaaaacattagccaggtgtggtacacatctgtggtcccagtgacttgggaggctgaggtgggaggattgcttgcacccaggaatttgaggctgcaataagccatgattgcaccactgcactctgccctggacaacagagtgagattctgtctcaaaaaataaaaataaaaagaatatgaaatattcaaccaacatataattaattgttatgggagctataaatagaaagtattatctctctcaattggctttgatcattataaacacacacatacacatagaaacacacacatccaccgtttaacccacagaaatgaaatgccaagattttcatgcattgtaaatccccatataaactaaactatatgaactaattatagaatactatctatctatttatctatctatctatgtagtcatttctagattctctattatctcctattgtttcttcattgatcccagtataattattgtgctatagtaataacacctgtatacctggtggtgggcaattctacacttaccattcagaattgtcccatttccacatagtttttgtttgtgaatgaatacaaataagaatggttttctacttaatacttgcctattagtgccaacatcagcttgactctactaaaaggcacacaagtgtatctttccgtctctgtggtgaagcttctcttttgggatgggctatacttacatttttttttttttaattaggaggaatatttccaaatgtccttcagcaagccagtatggtaccttatcagtgccccaatgcaaagctccaaagcaaacaaaggaaaactctactgtaagtgctcaaataaccatttcttatacttctgatacaatgaaaaaaaaaatttcttcaaaatttttcagttgcatgagaaaataataattcaacattgtgcaaaagaagattatattagaatattttacaaaagtcattctcatacgttttatacttacagatatattatatttttaaaacattattttaaaggagaattaacatcaattatactaatatgttctgtgtaaaacaacttagcaccacttttttaaaaaggcattaattcaataactactatgctggttgaaagaaaaagcaaaatttgagtttcacataacattggtctcattttcatcctgaattttaaacaaaagtctataaacaagattagagaaatcgttttataaatttgaatgttgagatttatataaatatgccattataagagtttgatacaaagtacttaatattttctattgatatgttccaaagagaacctcacaaagaatattttttctgtatggcaggaaaaatgctaaaatcccttaattgcaaatgtgaatttcccagctgacattaattttggtttataaggatgcacattaaaagcagtgttgcctaagctcctaaatataaacttagagtaagagtttagtaataagtatcagttatagaggctatgtgtataggttgcattttagaattccttggtgtttttagtcatgactaatgaacagcccactctcaaatatattctgaaggtagatagtttgaaacatcgtgatttaacaggtgccttactgggtgactcagccccttcactctgactctaacaataacataaaaggatttttttttttaagtgggacatcacttttttttttttaatcaagcacaaaaaaagactcttacgctttcaattgtgctgtctttaacttggattatggaactgccacctcgtcagttctcaagttctctttaaatgttctgatattttcaaccacatctccaagagaagtgatggtgtgactagagtctcactaaataatgaaagcttgctttattttataagttaactgttctaaaggcaagggctggagcctacatctcaaagtctaaaatgtcacgattaacttttttcattttctttgtcttctttgctcataatacaattaaatattatgccaaatttttacctgtgtgatacatagccatgattaatatttttgaaatgattttaatactttagtacaaaattattagaaaatatgataaataataatacagcttttttgggggggtctgattgaatgctaagagctttaagcacattaatttaattaagcttcaaagcaaacttatgaggctggtactatttgtattcctctttgacatatgagaaaattgacacaccaaaaaattaagacacttgcccaaggccacccagctaagagtaacaaaattgggactcaaagtcaggaagactgcttttgctatatactctggaagagtatgatctctagttagatacaaagtgcttaataatttctattgataggtctcaaagagaaccttacaaataatgttgtttctgtatatgaaaaaatgctttagtacctttaattaactaatactcttctacagcttccatagtctgcaattatggcagggtcataatgaaaataaaagagacaccatttcctttacccagcaatgccaattcctacagttatacagcaaccccaattcaatcactcctagttctggaagtcccagtgtgctagtggtgtctcataggcttgctaatgtaggtatcctatagcatattgttcaggtcactgctatgaagtttattgctgtctaattttactcttgggttaacctgattcactcatcaaaaaaattgattgtgtctgtaactattcccatcattgagaaaatagtggagaacaaaactaaatccttgttcttataaagcttatattctagagaaatgtgaacagtgacaatttgtctgttagtaataaatgctgttgatgaaaaagtcgaagatagaggatatcattttatgcagaatggtaggggtaggtctcaataataagatgacatttggaacaaagaccttaatgaaatgaggaacgatctgtgaagatcactggaagaagactattttaggaagagttctgaggaccatccaggggaccagcgtaattggagaaaagaaaacaaagaggtaagtagtatgtggtcagagagagagaggtggtcagaccaaatggtaaatatgtatagaagcataaatatgtccttatatacatataataagtagatacattcatacacactttcatgcattcaattctatgtattgaaggtagagcaaagatgattaagtgctggctgatatattttgggggagaaagaaaattaaatctaggatgacttcgaaattctggcctaagcaactaaaagaatgggatctattacaaaggtatgaaaggcagctgagtgagcaatttcttagaaggtgaatgagaattaggtattcaagttataaacattttaggcttgatattcctatttaatgtcaaaggaagatattaaacaaccagttgccaatgtgagtcttccttgaggaggaataaaacatctagggttgccacgttgtgaattatattgaatgccctcgaatagataagcacaccctcagagtggttatagaaagaaaaggcagaagaccagccttggatatgttgatattttgaagctgggaagatatgaaagtggttattttgttagactctgaagaaatagagggtctgagtatccttcagacaatatcccataatatgttttgcaaaaacagttttcataaaacatatgtggttgatttcatggagatattgtactttaattacaactgtggtaagaccctttgactttagcaatgaaccaaaatgaatataagggtattcttttatgcaaataaaagctctatttatgaggacatatatgttaatgcttgataggaattgctctagcagcacatgtcagctcttaacatttcgaggaggtagtggtagaggatttgatatataattatctgtaaatagtcaatgggtgttaatgaagtggaaagtttgttccaaactccctatgtcattcttcttcatattaaactggcagacaagaggaggtcaaattgttaaagaaatagatgtactccttggtcctaattttacaagatggcacaagaaccctggaacatacattcaaatttctcaatatacagagtacaaaatagaaataacacaatttgtacataggattctagtcctaggaatactctttgtacatttggtaagactgtgtgaactgtttatcttcattcacttcttttcccatttattaatcttaagagaatttaattatatcaatagctgaatctactacatgttaatacatattaatagcgaaatcggtatgtgttcttaaatttgtgcttgtgctctatggtttgtatacagaataatttattttttaagtaggagattgcaaataaaattacattttctcagatgatatcagattaagcctcaggtgaagaaaagctactggatatgagcaggttaggatatggtcaagctttacgtgctttttctcagcttttttcccccagtaagattaaggtgatgtccataacaatggtcagaggaatacatttgctctcagtttccatgaatataaactttaatgcttgggtgaataatgagaaatatatttgtaattttagaatgttttgcaagctgcatgtataaaactttgtcaaggaaatctatatcacataaaacaatcgtacaatcacgataaaagtatattcccatgaaatttagaaaagctaatggcattatgctcccttgatttcatattatcttgtcttttttactattaaaaattaaataattaaaatcaaatttggactattattgtgaacacaattatagtttcttacaaatgactgaccttaataaacaatttttttaaattttaactcacagttcaattaaaaactttaattagaactggaataaatttattaaattttctgtaacaaatatttaatatatttattgagtaaataaattaataacatgtaatattcatatagtttcagaaatactttgttttaatattaataggtaagatcataactagtaataatggctaattgttcatttattaccattaagtttatatttatctacatataatgtagaataacaatttttataagtattaaattataatctaaatacataaagtttgttctagaatgtgaaccaaagctacaaaattaattttactgatttcatccactgtattgccttattttctatgtgaacaaagagctggatcagcaaaacatttggatgagttgtagtttgtgttgccaaagaagagcatagagctaattagcctatataggaaataagctcatgcttttcaactctttagaactatagtctaaatactgagatagtaaaattgccaaacagtccataaaatttgcatgacatttatttaaaatatcaagtataatccatggtgattgagattctatttctcacccagaagttcttcaactagatagtaaaatacttggaaagtaccaacacacacacacacacacacacacaagcacacacatagggcgttctcttcacactgtcggtggaaaacacgaaagcaaaaataaatgcctaaaaatgcatgttagaagtgatgctttaaacgtagttttgttactggacttacacctgtgaagtcagaaaaacttcttggaagcttttgttacattttcatgtatttcactttttaaaattattacttctgttagcagatttgtgctaaaaatgtcttcctaggtaagacagcaaatgtgctcagaaagaggtgcgaatgctttggataaataaatgttaccagctagacaagcagcagctggtaaccagaaaaaaggaagttcccaccaggaaagaaaaaagatttttctgaatagaataagtcagaaaaaaaaaatgacaaggtatggcatcataggccttgttgaactaaagacatttcatgatctgaagtaatgtaattgtaagaatccatgagatagtgggacaacatgggagtttaatctggggtcagcaagctttttctgtagtgggccagatagcaaatattttagtctatgtaggctacatactctctgttgcaactattcaaatttgcttttgtaccaagaaagcagtcatacacattatataaatgaatgattatggctgagttccaatacaactttatggatgctgaaatttgcatttcatataattttgatgtggcatgaaacagtgttcttcttttgttcttttcaaccctttaaaaatgtaacaagtgttcttatcttatgggtgatgtccagatttggcccatagatcatagtttgctagcttcaggcctaaatcatcatagaactgcaggaaatccaacactggtggataataatagtacctttatattaatgagcctctttttaattgaattgtaagatgcttgcaagtgaagagggtaaaggtgctgggtgtacttattttcctttgttatttgtttatatgactatcttcacccagaagcataatgagagctcaaataaaccagtgtgctgctcttcctaaaatagttagggccttcaaaactaatatagtcattcaaaattacttaattgagcaccaatatatgccaggcactgtcctgggtgctaggaaaacaatagtgaatgaaagaaacaaattaacctcaagaagcttacctttcaggattgtgtcttaggacaagctccatgtaaggagaatctgagatgtggattcttgtatatgtgatgcaatggcaaagtgctctcaggaggaggggaatggggaagaaggacaaggcaaaacataaaaaaaaacctaaacaagaatatggacttagcttcagactaccgtcaaattgatcccatggagaaaatctgaagtagaaactgtaccacagttagctgtactctgaggcaagggggctggacttttgtactcctgtccctcactggagaggcacctcctatttggcctgagggtaatgcttccaagggagacaggaacattcctgagtggtcattagagagatctgggcataaaactaacatcatccactacagaagggtgacaaataataaatataaatattaaacatttttaatatgtcaggtagtgacatggctttgtggctagaggaagacagagaaagatataggtagagggattgattactcttttacatcaagtggccaaggaagtcctctgtgataatgtgaaatttcagaagagaactgaggaaactgagtcccagtcattcagttatctgagggaagaggagttttaaatcaagacagaactagccttagaatgttctagaatgtgtgagaagtgggatgtggctgaagtgttaaggatgagtggagaggtagaaactgaagctagatgaaaggggtcatgacagattacatagggccttgaagaacattgtaatgtgttcagcttttaccctaagaaacaaaagcaccaagtgctacaagtatgtgcattatacttgtagaacccagacgggctctcaaaaaccatctggtctaacttctcaattttagagatttgtacagtggaaaatctctttgaagataaaagacaaggatagagttctaaaatgtatggaaagtgacttcccatttaatacatttgaagaaaatgctgctataaatatttgaacagtttctacagattatgttcatttgtttaagtcctgaatcttaatgtcatcccatcaatggcaaaactgtgagaggatgagagacagctggctgatgcacagaggatgcatgctcactgtctgacgttggcttggcatttattctagctgtaatttcagcacgttgggaaagggaaatagtgataataatttcaagcaagtgagctgtattttctttacatgcagtggtcagctactgccaagatgactatagctccataaattgttatttccaccaaatccaatgcaaaatattttatgtttaaattgacaaataaagaacaaaaaactattcttggaagataatcattaagtagttataaagcaatttaaaaataacattgcatatgaattcccattaacaatagtggtatcttgtgacttctattagtttgaaagaaatattccacttcatgttagtactggacttcatagaaatatttattagtgggttcagccctctgttgttggtgttgttcaatgtatagtaactatacccaatgtttctaataattcaaaaatatttttatgttccaatgcaaagccatatcttgttttcttgaaagagaatttcttacatttccagctctaccttaaatggtccatatcctagctctgatgtcaattctcctatatgcaagttctgatcttaattctgcttcctgattctttgctattaaaaagttctctggggtgatgattacccctgacggaggagatgtccttgaaacagaagcctaattttcatctcctgtgtcatacttcttcttcctccttttaaatatgttgaactaccaatgacatcaaaaagaaatttaagccaaagtgaagcatttggaggaattaaaaagttttaactgaacatctttatatatcttagtttaattaaatctataattaaaacagcattgaagcatacatcttaaaaagatcacagatgaaaaattcagttatttcctgaaatttcaataatatatacatattctaatatctaggtgaaacaaatacatttcaaaatgtgttgtttaagttcactgaccttaaaaaagcaacatattgctgataaataacatcatgacatacttagcttaatttacataaataagcttttaaaaatatatagaatatttcagtgtaagggaacatttattccatttgcttacagttaaagagttatgtttgtcttattaataaattatatccattctatctgtatttagagttagtaaatttacctgtaaaattgtgtccattctatctgcatttagagttagtaaatttaaaaaaaaatgtaatttaaacatagtctggcattccctaccttaagaggtcaagtgtaaattcttgtgaaattacctgtaatataattggtgaagaagcatggcctacatctgcccaggttttaaatttcaaataaaagcaactccctaattgttactctcttctgtgcagaaacacttgctctcaacaggattctttaattaggaaaagaaatgtttctgtaaaaggctcttactgattatacagtaaaatgctttgggggaaaaattgctttaaattactgacactaaatacatttggatctgcatgtcaaatgcacatactaacttcattcttggatagccaagagctacacacataagtggacctaaaatgggtagaatataaaacttcagttagaatgtcatctgtcactttccctggtttccctgcacagcacttgtttgccccttttggtaaagagatctcaacttctttgggatgctacctgtcttcaatacacaataggaccaccaattaaagaactgcacccttctagccaaggtatggccctgtgactcaaattaggctgcctcaattctctgacctgggagtaaattttgaacagagttccatgaaggtggaaaacaattagaggtaattcatcttatgtacaaacaccttatcaattgtcccttagttcctgctcaatccttgatccccatttttttctggaatataactattgggtttcctttttgtgactgagctgacttgtatacacttaataaattttttttgtttgtttttttggctttagttagccagaatcaacttttgttacttacaaccaaagatccctaactaataacagctcataaaaatgattaaatattccatgttcaaaagcatttaaattgaaatgtttgaaatgtttctaataacaaatcagttaaaatcggcacataagatgaactataaatcttaagttgggaagcacagcaacaggcaggcaggtgattatgaaatggatgaatgatagcgtcctagctaaaaaaaaaaaaaaaggtggccgtttttattgcctagctgcagctatcagaaactacattaatattacagaaaaggggaagtgtaaagcctctagtgaaatgaagaaaggggtgcagaaagggccaactgtggagaatctttcatgttgaccccagaggttttcctagaaaaatttccctgaccaattttctttaatgatggttctactctctaggactatatattttgcttcgcatgtattctaagcttattgcattcctcaatgcatttataaactccaattgggaagggactatggttactattttttctatatctggtagagtgattgttcagaaattctattccattaacacctaatacacacacacataaacacacacacacacacacaaacatacacacacatatgcatacatctagtggcaattttatctctacaacttctcccagtgattagctatctgctattaagacatgatttcaaaagaattgggggtctcacaaagcataaagcttatcccccctcacccctgttccaccacctacacatgctaattcaacctgagagtgactaaaagtttacgatgagaaaaatattatttttactacaagtcttttataaaagcaactcaaccttttttgtcataatttcatgacagagcactgatatcatagcagccacacattttttagtcacataaaactggcttcatctttcactgtttgtttgatctgggataaaacaagcattctctctaaacatctagaaaaaacaaggtaataataacatcaacctcagaagggtttagcaaggatttcagtgagatataacagtgtctgatatattataagcacataatagatattactattattattatttaaaacaatgtgctgtacaatcataatatatctgcagtggtggtgtaggacattagtttagatatctgatttctaattgttattagtgtccaggaaaaaaaaatcagtgtttcataggacactttcctcagggcatttagatctaaaataatattttttattgtacaacttcatacagatgatgcaatatataaagtagatataacctaggagtattcaatgtgactcattcctcagtcttccccaagccccacgtttctcccagccaagattaatcttaacaaaaaaatcaagtagtcacataccttgccataatattagaagacagtgtatgacaatcatcattaagaacttgatgtcaaatatatcaacttgtctctgacagatttttctctaaatgagatttactgtccatcaagtcatatatttatgatcttaaatgtacttattactagtatcttatccccaaatctaaataggctagatctgacattgacctttattaaaattacaggtagttatgcttttgtagtttctccctaaaatttaaaaagtaatttctccttaatcaacaaaggtttgtctgacatcttagaaccccaggagagataggagataggaacactatctcaattccatattaagcttcaatttcccacagcaaaatcccttgaggaatagttcctgtattttcctccctttgccttctggaatgcaaatcaggacgctacctcaggcaggttccagttcctacgaaggaagttttatattatcaaaatattaaatttatgttccaaatcacctcatttcaactctcctaaggacaactcctcttctgaaaaaaaacaaaacaaaaacagttcaagggatgtttatgtaagcacgctgtgctaccttcatacaatatgatttttattcaaaatttctcttctgaagattcatgaggatgcattttgcaaagtataaaagatattaattacctgttcaacttgtcaggttcagaaaatacatgaataacacatcaattagcaatatataacaccaaagaacaggacataacctaagaatttaacctcctatgatctgcctagcttcaatttaaagtctaaaggcacaagtgcacatattaaagcatataagcaaatatattcagaaacctagtgttaagaatattctgtgtttttaccttgctgcttcatatttctctgctctactaactgcatgcaaaccctttaaaacctataattaatatctcaaaatgctaactagttcactgcactcttcctgcctgtatttaaatataaaagataaaggggacacagtttgccagtctacagaaaatgcacagccaacctgcacaagctgccacataatttatggtgaggattaaatgaaatgatatatgacacatatacaattagttcagacacagacagctgaaagaatgttaataagtcaaaagtcaatgaactttcttaagattcatgaaaacaatgaccaaatatgtaactctgtaaaaactatccatactgtggtttggggggaaataaatgaaatgcattcttagctgtcattatagtcacctattctgtcattggtattttaattctaacacacttcccaggtgtccatgaaaagaattacacttctttcataaaaaacgatgtcatcactttatagaacacaattatctatacacattgaaaagcttccagttgagtttattaaattcttgcaaacacaactattgtaatgcaaattagagaatataaagacactctagaatttctgtctacaaagcaagctcactgagaaaactctgcatattataatgggataattcccctttaagttgctttatatctgaaagcataaatcagagggtaaaattaagatacatttttccttcatgactgtaaataaaataaattgtaaatggtattatctgttaattttatctaaattatcagctaaaatgtttgagattgaagtacattttgggatatttcaaaatattattacttcactcatttcaaataatcaagctatctacaaatataagaaaagtgaaacagggaaaggtgactgtttcataagagaatattcccaatcatcttttggcttggttacaatgctctatctctaaatgtgaataatcttaagaaacaatgttagaggatttataggatatcttcttttaaaaggccatatttgacattgttaatagtgattgttaatcgttctacataaagtttccaaataacattgtgttatgcctgactgataatgtaaaagctctataattataagcaatgacaagatgttattaaattgcttatgtaattttgagccttctatttatttatttatcatttttataaatttagggggtacaaatgcagttttcttacatgaatacattgtttcatggtgaagtctgtgcttttagtgtaaccacaacccaaataatgcacattgtacccattaggtaacttttcatccctcaaccccctcccactctctcacctttctgagtctccagtgtttattatttcactctcttatgtccacatgtatgcattatttagctcccaattataattgagaacattcgactttcttttttgagttatttcacctaatttaagacaatggcctccagttctatccttgttgctgcaaaagacatgatttcatcctttttttatgactaagcagtatcccatgatatgtatatataccacatttttgtttacccagtcatctattgatgggcacttagattcattccatatctctgctatagtgaatagtgctgcaataaacataagggggaaggtgttttttgatataatgatttctgttcctttgggtagatagccagtggtgggattgctggatccaatagtagttctatttttagttctttgagcaatctccatactgtttcctacagaaattgtactaatttacattcccatgaacagtgtataataggtcctttttctccacaccctcatcagcgtctgttattttttgacttttaattatagccattctaaccggtttaaggtggtatctcattgtgattttaatttgcatttctctgatgattagtgatgttgaacattttttcatacacatgttgcaaattgcctatataattaattcagctttttttcagttatgtcagatcaagggaacaaaaataatatcataatttagaaaaacttacataataagattaggtctacataatctatatattaaattccatacaatgagtaagtttttttccccaaactcccttagaaaatacatacattttaccataatagaagacacatcaagaaacaatttaaaaattggagccaatagagaccacagtttctgatcacagtgcattaaagataacactaataaatttagaaaagaaacaaaacatattcccatcagtaggaaaggaaaaacaattaatcaattgtttagttcttttaaactgcagaatattaatacactgcctatccgaacctattagaaggaaaccaaagagttctcaggaaaaaattagggtcttaaaatccatgttaatgaagaagaaaaatttaaaataaatgagttaaacatctaactcataaagttagaaaaaatatataaacttagagaaagtagaataaagtattttaaaatgataaaaatataaattgataaataagaaaacatacattgtagagatgataaaggaaataaaagtaagttgaaagaaacaagcacagacaaccctttgaataatctaatcaagaaataagggggaggagaaagaatggaagcataaagtaaaaaagaaaaatgacaataggtaaataatagataccataaaaaccttaagaggacctagagtgctttccagtaatcaatactataaaaaaccttaagaggacctagagtgctttccagtaatcatactctataccctaatcatattttctttcactctcttaggaaactatttcacctcttctagactcaaacttccaagtcctctctcatattcactttcaatggatgcccttgctccctacttcactgaagaaattgagtcaaccagaagagaacttccaccaactccccaatcacatcttcccacctattaccatctctactgatatcctataacatctcattaactatcatcgaaaaaataatgtatttttctactaaagccattccatacttttcctctaaaactactcgaagacagtactccaggaagtcccatccctctctcataaatcacaaatgtatggttctcaaatagattatttctatcagcatatgtccttgaaaacatcctgatatctgtctggaggaaaagaaaactttctttctcttaaccccactttactcatcagctaccacctgttcatctcttcccatttttagtaaaattccttgaaacaaccctttatacttgaaatcttttctcctactcctcttcttttaaagtcactgaaacctggattttgtccaccttgagctactgaaaacttgcagaaagagggtaatatgctagaccctgtataagtttgggaatgttcatagttgagttagacaccagctttgcttctgagaagtttctaatgtaaaacagtaatcaccttccctagaattacaaacaattcaaatcaacagagaaactaccactaagtaccaaaacaaaacaaaacaacccacagatggcccatgtattgctattcgctcaaaaaagattatatggcctgcctcttattgtgtgaactgtagtatctgcatctggggtaagtgagctttccacaccattgcctttaagcttagctttggccaacagaatgtaagtagaagtactgctgtgatgcaacaaaatccctgagaaccattgaatgacctgccaattgctctttttagttcctactgcttcaagaatggcatgtctctgattgaagctactttttagctgggtcttagaataaagaagacatgtgggacagagccaaagccaaggtggccaatatggtgcaaaaaggagaaacaaatcttttttgttgcaaaccacagagatttggcttttgttgttatggcaacatattctagcaaaagctaattgatgcagcccaatttaatggtgcctgaaaagcattaggccaaggaattctgggttccttccatacatttcagaccatgtcatatcaaatcaaaataatgctatttttctccatcacaagcttatttatataactaaaggttcatgagcaccttctgaattcatagtactaggagtcagaaataaattcttttcaattgtatttaactttctattggctcatttagctcttctgttcgccacttcttggctgtttcgaacattaatttacaaaagacagtttttcactaaccatcaaaagaagaaaacttagaatgatagaaaagtaatataatttcattgccatttaatcctattaacatagttcaagtatttctccttgtttctatgctgtttctttggggatctctacttttgctactcaaatagtcaaacagaggcatctgagagcttgttaaaaatgaaggctccaaggccccacccaagacctactgaaacagaatctgcattttaacaaagtctccagctgagatgcacattaacatttgagaggctgtggtttataaaaaaacaagttctcctttttactagatgttctttttcatagatctggagtagttaacagccaggatcattttttctttttatgaaactttcaggtgatcctgatgtaagagatttatataatacattttgagaaaaatcaatttaggcttagctgagtatgtctgaatctccagttttgacacttagtactagttgcatggctctgtgaaaactacttctccaaaattcatttcttccatccatggtgaagttactacctatttctatttcacgggtttataaggttctatcagatagtgtacaaaatatctcactgttaactgcaaaggagactaaaacaaatgcaaagttgaaacatattaggaacataataaaatgtgttgattaatatgatgaatgtgtaaatgaatactattcaactctaatgcaataagaagaaataacacaaaggaatgatattaggttatgggaaaatactgccaaaggctgacacagtctctgctggtttggactattgccttcacttttggttgtttgttgtttgtatttgatatctctccaccaagtccaagagcaaaaaggctaagaatggttgagagtatcttttcttatagggctatttaaaatagtcatgactttcaatcacataaacataatattaaaaatgtcaatggcaaaaaataattcaatataaacacaaagtaaaaatcttccttccccaaacatctttatgctcagtctcactccccactttcaatcatttatgtttccaggttttctgttattttccactacagcataattttaaatagtgcaagatgagaaaattagtacaactatacttccttctacttgctatccccctctccttctctcagcttctattatctaaattttaataaaaactatagtttgttctgtaactatatctagattttccttgtatttcctatagattacaatttttaaaaataagaacatttaaaatgttataaaattactgttgttttgcagaaccaagaaaaaatattgaacaaacgcagaagacagatttccttgccattaaaactgctttttagtaaagcagttgaatttgataacccagaaaaagaattctaaggtgactaccagaaaaagagtaaacttatttcaaaacattctgacctatttaacaaaattcagcaatgtgatagatggtattgagagataggtggacagatgggtaaatgggatggaggaagaaaggacatttttaaggaaattctcaactcatctatctgtagtcaactctgaaaagataataaaaccacatatttataccaaaagaacgtacaattatgggctacatatatgtaaacatcaagacactttcattacgaaatatcaaaattgttttggaagtgaatggacccttgaccaaaaaactgttaataattttattaacttaaataagtattacaataaaaaattaggaagagaaacaaaagatctgtttttttatagggtccaaatagtgttatatctacatttttagaatgactacattagcattttcatcactgaacttgaataaatggactcatttaaataattagcacttagaaggcacactaaccatggtcacacagaaaaatttcataaatgataaaacattcaagaaatcgggatttatttttagagcaagtcctctggatacttttgaaatgcatcaagccctagtgacaacgttggacatactgaaaacaattgtctttctgtatcctacactgtactttgcagtgaattcctgactttgatattgtgaatagtttcagatatgcagcacatactttattattggagatatttttaaaagtagcctcaagtgcggtaaacagaacagccccccaaggatatctactcagtaatctgtggaacctgtgaatatgttacatacatagcaaatggaactttgcaaatataattaaggttacggaatttaaaataggaagaatatcctggattatgggtctaatcacctgaggccttaaaagtagcaacatttctccagctggagtctcagagctgcagcagaaggaaaagtaaggagatctgaagcaagggaaggaactgatcagaccattgttggtttgaagacagatggggaaaaattaggatgaatgcagcccacttaaggtattgaaaagttgcccaccatagccagtaagaaagctgggacttcagttccacaaccgcaaggattgaattcagccaacaagtggaatgagcttggaaagggatttgtccccagaactgtcagaaaagaatgtagcctttgctgacaccttaattttagctctgtgagagtctaagcaaaagacccagttggctcaaggtctacctgaacttctgacccacagaattgtgagataataaatgtgttaagccactaaatttgtgatcacgtgttacagcagcaaaaggaaaactaataccatatgttcctttcctcctttgcatagagaaagttctacacattatgctcctattttgaatatacccattttccatgataaattgagcctggctaaattaaatgaatattaagaactattcaaatccaagtgtattagtctgctctcatactgatatgaagaaatatctgaatctgggtaatttacaaaggaaagaagtttaaatgactcacagttccacattgctggggaggcctcaggaaatttactatcatggcggaaggcaaaagagaagcaggtaacttcttcacaggtggcaggacagagtgagggcaagcaggggaaatgccagatgcttatgaaaccatcagatctcatgagaactctctcattatgacaagaacagcatgggggaaaccactcccatgatccaattacctcaacctggtcccacccttgacatgtggggattattgggattataatttgaggtgagatttgggtggggacacagagctattatttctggtttcacaaaacaaacacttggaccagaatttattctgtcctcaaatggaaaagcaactaaccttgatatgtctgctatatgttagataacaaattaggaaatttgtaaataatattttatgtaaagttcaccatgttccaattaaatgttattaccctaaacctgagttaatctaactacagggtaatagttgtttatatgagaattggtctagaaggcacgaaaagtataaatgagttcttgttatgacaaaaaaaaaacctagaaatttctgagttaggtgcattagtaccctttataaagaatgaagaatccctatttaaaaaatgtagtagtttttgattaaaactgttacatctctgttgctcctgccatcctggtactgctgctcttattgcaactgccagagcttccacacactaacatcacttccactgctacgcactaccctactacaaggctcagttgaaactcacagccttggtcttcagaagccctgttttggatgctgttctatgggtcctacactggctgttcaaaatgctttgttctctttcatcccattttcttcttttcttgtctgaactcagcagttaaaggaaggctatatctggtctgtctggagagattgagatggaaatgtaactttccagtgttttttccatttctgcacataacagtgtgaaatacctgaatctgaaggtttagcactttttttgtaatttctcttggctatgaatgtgggtctcatttacttttcaaaaataaagatttgagacacagggaggttcagtgggttaaggtaacttgaaacccaaacttcaaacattgcgagcaaatgcattttctgtctcaagtttcacaaaagagccttactgtgcttatatctcaccataaaaatctaaacatttgcttttaaagacacttcagttaattaaaaatatataaggttgaaatagtattaaaagtgatatatcattatatgagtatatcaatttagagtgctggttaatgtgagggttcagaaaacagacaaccttgggtagaattggaactctgccatatactatctttgcaaactagagaaggtgagttaatccctctatgtcagtttccttatctgtaaaaggggaataataatagtacctctagtcatagaatggtggttcagattaagtttgttatatatgtaaagtccttaaaactatgcctggagttcagcaagctcttaaacatgagctatcaattctggttctgattctagtcactaaagagtcagcagtgcaggggtgggtggggagttctaaataattgtattaaagaaagcatgatgaaaagatgaaagttaattcttcaagcctatgtcacaggatgatatgagaaacacatgtgaatataacatggactgtgacaatatataaagtaattagaaaatatcatatgtgtaagggctcagaaaatgtatcaccactcaaatatctttcttaaaatgcttacttagaaatacattccttcaggcaaagtgatgaaatcaaatgtaaaatataaaaatggacaaatggtgactacaagaatgatagaatcattcaaattgaacatattaatagcatttaaataattgctaatagcttaatttcaaatctgaatgcaactttagactggattttgcagtaaaaataccgcataaaagtttttaataataaataacactttatgttaatacaaattggaaagtccagtgtggggaaaagagcaaggacagagaagtattcaattcttcctctttatatgttggaccagaagatggaatgattactttcctgattataccaaataaagaaatatggatgatgtttttttttaaaaaaaaaaaaaaaacactcacacacacaacaggttccactagtttagttacaaacaatgtgtatttcttacatatactgcagaagagaaaaggcaacaaaacccatttcaacagccaaagcaaaaaagcaaaataatatcaaggaaggaaaaagaggaaataaaaaattaatgacatagataattgctcatgatatgttaagtgaaaatgcagtgtataaaattacatatagtatgcttctaattttgagaatagcatctttctcttagtgtaaaagatgataaagaccatcgacctaaattgaactttaagtaattatagatgcagaaacttgaatattttctacaaagcacacaaaaaaagcagtacaaggaaacaacttccaagaacagacccaaaattaaacacagtcaatatgtaattcaaagtagaaaatcaccaaaataggtattataaactgtgttgaaaattaacttagagcagaccagtaaaaagcaaacaactttcttagttacgtctggccttgtatttttgataaatttattactgaaatattttataaattaatacaacaatcttttattgtctctatatagtagaaatatatatattatggttaagtttatgatggtaaagtacataaaattccagttttaaagtgtgagacatagttcttaagaatatctctctttttaggttttaggttaaataacttctccagaaatataaagcaactagtacgcatcaagtgtttaatccttgttcttgactttctttgactctaaaatcttaaatgctttaaggaagattgcgttttaaaagtacaatggatgtaaattttcagttatgcagtatgaataagttcaagagatctgctgtacaccattgagcctatagttaatactgtattgtgcacttaaaattttgttaagagggtagatctcatgttaagtgttcttaccacaataaaaaataataaaataaaatgagggaatcttaaatttaaatcttgtctctgacacttaccagtaatgtgagaataggaaacatacttttctgagattttatctatatataaaatggaattaaagagattgcttttacaactcttatgaagataaaacaaaatatttaaagaggcaatgaatatattgatcaacagatgcttcttcctattctactacactgagttctttgctcttattcattttctgtcatacttctatcattgtcatatttctatcacatagaagtgtaaatattggtttaatcatcagtcacctcaaataagctaagcattcctgaaagggagaagcatttttcatcatctttttttgtttctataagccatcaggataagcaacattttatcctgtaacctacatgttacattgccaccaggataacctacatgtctatcttttgtattctcataaactagataacgtgcctgctacacacatattttatttaaaacttctgatttgagggctgtgtcttctgaaaatgtgtaagaccaatgagcacaggaatgcagaagataatcagcacctgtcccagataatcatggtctcatattaccactgtttcctatttcagggtgcatattgtgcccaaatctgagaatgctgtggtgaaagtgataggtgctgtggagctcacagttggagtttgtctctaaccccaggtgaacctcttcaaacacctaacaattgttgagtctaaataaaggctcacacagcactgtgtttgtagtttgggaagatatgcacatataaggaaaaaatctctttgctctgagagattacattgcatttgcagaaaaaaaatgcatacaatcacactaagcaagccatcattaataaccagtttagacttgtattttaagttatgtgacagaatagaagaatacaaagggggagagaggcagattagaggtcaggcttgaagacataataagaagcttaatcatttattttccagattagcattttacaaatgtaattctatgaattacctaaggtgattgttaaaagtataaaatcaaaatttccagagaagatgtcattgtcaacaagcactttgagcaattctccttttcagtcaagcttgtgaaaacttctctaggtgattgggagccatggaaagttattttttaacatcttaattgaaaaataatttacatatcacaaaattcctttgtgtttagtgtagaatgctatgattttaataaatgtatagaggtgtgtaatcatcacaacaatccacttttaagtctcccaaaaagatccctacccatttgctgtcacttcctatgcccacctccagccgtaggcaaactttaatctcctttccatcttatagctctgacttttctgggtatttcatgaataaggaatcatgtaatatgtaatcttttatgatgggcttccttcatttagcatgatgatttttaaagtttcattcttgttgtagtgctgatagtttgttacttattgctgaatagcatttcattgcatgaatacacaatattttctttaccacctgagggatatttgttattatgaataatgctgctatgaacatttgtgaacaggatatacatgaaaatatgttttcatttcccttggttagatttctaggagtaaatttttttaattaaataaactactagattatttttatggtagttgtaccatattacatgccaattagcaatgtatgaaagttcttaattcaccacaatgtctctaattctgggtattatcttttgattataaaaattctagatggtgtgaaatgtggttttaatttgaaattcctaatgactacagagattgagcatatcttcatctgcttattgacatctatttaccatcactgatgaaatgtctatgcaaattgtttacccattttttaattgggttttcctcttcttattgacttgtgagagttctttataaattcagaatatatgtcctttaacagagatatgttttgaaagcattttctcctagttatcttagtatttttcattttcttactattttgaagtataagttttttttattttgatgaagttctatttataattttttttgtggattgtacttttagtgccatgtttaagaaatatttgcctaatccaaggtttcaacaatgttttcctattattttcttctgcagagtgtatcgttttgctcttacatattggtctatgggccactttgagtcaatttttgtgtatgatgtttggtaaggttctaaattagtctttgtgcatttgaatagccaatcatcctagcctaatttgttgaaaagactatcttctccacattgaattggtataattgttgaaaatcaattgaccataaatctacggggttattcttgtactctctatcattatacttgctctatatgtctatccttaaactaacctgtttactgtccttttagagtaagttttgaaatcagtaaatgttaaattctccaattttgttaatgtttttcaagattgttttaattatccttggtcctttgtctttctatataaatattaaaatcacctcatcccttcctgtataaaaggctgctgacattttaatagaactgtgttgaatttatagacaaatttgggcatatatgacatcttaataatattgaatattttaaaacatgaatgtctctacatttgtttagatatttttacatttctcttaaagtcttcactatacaagccttgcatgtattttgtttaatttactcttaagtatttcattattttagatgctattatagatggagttgttttaacttcatttttgatcattcttcgatactgtaccaaagtacaatttatttatgtatgtttatcttttatcctgtgaccttgctgaattggtttattcattctgttgggtttatttgtggacatagacgcattttaataaaggcagtaacacagtcagattttaataaaggcagtagcacagtcagatttgtattttaaacagataactctgcagctgtgaaggggatgcatttgaaggaggaaacgccggaggaagtaagagtttttcaacaccgttgggacaattactgacatctagaatactcaaaggaatatataacaagactaggagtacaccagaaaaaaaattgaaaatggtaactgcttattttgtcatagaaatggacatgtttattttaagaaaatcattttaagctatcttttctttgttttttagacaaagtctctgtctgtcacccaggttggagtgcagtggtgtgatcagttcactgtaacctcaaactcctggactcaagggattctcttgcctctgcctccccagcagctgggactacagacatgtaccaccacacttggctcatttaaaaaataatttgtagagaagggggtctcactttgttgcccatgctggtatcaggctactacatttatcgtgcttattaaagttgcagacttcttccaggaatggcagactgtgtaattgggaccagctctattgataagaacaactagaaaaattgggtaattttttaaacaaattttaattcacttttgaagtgaattaataaaggcaaaaaaaaacagtgaagattttagagtttgggatctagggaaaactaagccctcaggcatttcgacctgctttttccctagttgtggaaaaaggagaggctggctcagcacatttggcaacttcacaaggctgaagagatgggaattgagatcaagtcctttcaagatgcagtagccttaatgaatcttcctcacttggaggtgagactcctaagaactgtaccctagaagaaataatccctggatgacagatcttcccagggattatctggattgaggtaattaagatcactgtttttccagacatctggccaaaaaaaataaatgttccctctagatgaagataatattctcctagaactaaaatgacttccactgatgattttacaaatgagatgactgtcacacagtcaaaaataacaatgtacatgatataacttgacaaaaatgaataataattcaccaaaagacaaatgaaacagataaaaggaattcctcatattcaagttagcagaaagacttaaaatggccatgtttcaactgttaaacaaaattaaaaacaaaacaaatggaaaagaatgtttaaagatagtaatcacaacaaaatattaaatatatagactcaacagcaaattagaaacagcagagaaaattagtgaactaaaatttcagtacaaaaataaaattccaaatgaatcacagagcaataaggggatggaaaatatagaagaaagagtaagaggaatagaaaataaagtgagaactagcatataggaagtggcattccaaaatgaggggggaaacagaatgtgatgaggcagtatttactgaacaaaagtaaatatttttccaaaccaataaatggcagtaagtcacaatgttaatctctatggacactaagaagaaaaaaaggaaaataaaaacaaatacgttttaagtacattatagtaaaacttcttgtaaagaaaactctctaaagcagccaaaaagattaaaaaaaaaaaggacagtttactctcaaagaagaaacaattaaattgacacctgccttctcaacagcaacaatgaaagtcagaataaaataatatgtcttagtgccaagtgaaaataaccactaacgtaaaattctatctccagtagaaatacctttcaggaataaaggtgaagtaaagatattttctgaaaaacttaaaccagaaaaattactcatctgcagacgtacagtaaaagaaatattcaagtttatttttcaagtagaagaaaaatgatcccagatgaaaagccagaaagaatgagatccagaaagaataattggtaacataaatggtatacatgtgaataaatctaaaggaatattgcctgataaaaatataataatatatttcacatcctacacatggaagtataaggcagggaaagtatacattaacattacactttgctaaggatgcacattgtaatttgtaggttagcaaaagaatagcaagagtgtaaaacttctagataacagaggaaaaaaatgcaattcaaatggtggcatgaaaggttgatttaaaaaaaaaacacaggataggaaaaatagaaatcccttggtaaaatagtagactaaatacaaatatacaagtatttacagtaattataaagataccaaataatttaaagagaaagattatcagtctgcatacaaataaaattcagaaattgtttattatttgtgggaaacatatataagaacacagacacattgaaattagaaatatagaaatggcacacaatgcaaacattaacagaaaagaaatctgctctaatactattactactagtaataaaatcagattaaatagaattcaagggaaaataccagtccagaaataaatgggtcacttcatgatgataaaaggctcaactggccacgaagttatacatatgatatagtcaaataaaactgatagcagcctcaaaatatatgctaaaaataaaagaattgcaagaagtagaaactctataattatagcatgagacaataaaacttgttattattctaacacagaactttagatgtggaaatgcaaaatgaagttacatttttaaaaaaacaaattaaatatatttgacagttactaaaacttatgatttcagaagtcacattttctataaaaggaatactagctgaagagattttctaactcaagcaacatcaactgccacagattatttgtccagatggaatatagttcatagtactgtattctgatagcatgatggatcagacaattggctaacataacttttaaataacctttttataagcattttaaaataaacttttctatatacaaaattaacaaagataatataattttgatatttagaactgattttatctcctttatcttagaaatagatcatgaaataatattcttatcagggaaaactttcaattcaattaccaattttttaaaaaaacttggtcaattaatctattatcgatcagcaacatatcaatgcatcttataaactcttataagaattaataaaaaattttgaactatatcacatatcttaattgaagcagattacactaaaagtggacataaaaagagaaaatcataggtaagaataatacatgaaaattaatttaccgtacatagaacaagatagtgtcaaattctaatcacataaattcctaaacaatttcttccaggtaacatcaatattaacatgggcttatagatttaaaaaagaaaaaaacaaaaacaaaaacctcttcaaaacagaaaccttcttctggcaaatatcttaggaataactattagtctttgtacttgcctggaagacaacctggggcttcttgacctaggagggaaagcagagctgggagccaagagcaatgagatttcattttcttcctgtagcacctattgcaagttccagggccaacaatctcactttttgaaaagcaaaaatgatttaaaatattcatttttggggaaatttgttctaattcaaggcccaaggaagaaattgccagtcattcagaatcttactcaataaatttaatcatatttgagagaaaatagtagagccttattatgagtattttttaaattatcagtgtcacaaataaaactctgattgcaatgcaaattgtaacttaaaattcaagccctatgtacgtttggcctatgaatcttttcttaaataacttaattgttatgactcttaagtaatcaaacagcaagtagtaagggtttactaagagccaggcagccttagctaattcagagatactattttgtaaactgatttaattgcagagatcaatgcaaaggtgtgtgatctacttagagtgtgatagtcatgttttaaaagaagatgtccacaaccacagttctaaactctccttttcacaaactgaggaatcgtgatggttgttgctaccttaccctcaagctgtaaagctctgaagtgaactattcaggaaaagtaaatagtgtgaatttcagtgtttctgttactgcatatagaatttctcatcaaagattcataaaaataaatgaatcataaacatgctaatattaagtacaacaaattagactataaattttagcaaaaaatctcaggttaaatagaaactcatcttgataatactaatgactatttttctgttggtatcattccttctgacagaataacaataagagcaggccaaaaaaaaatagaataattcaaatataaactattccaaagtgaaaaactaatcaaaatattctacttttcattttgtccttccacaaactgaaagtcggatatagataataaatagtggtagcagtattataaagtcatataaatattcatacacttttttttgtgtcaaaagtggcttagtttaagaaataaattccttagtgaaaaaacatgaagaatgtgaaaaaaatggaatttcaaatccacagaaattgtgtcaatatctcttaaaaattccttcaaagcaaatcatatacattctgacctcagtgctatgattgtaacatattcaaaatgtcaccaccacctcttgatataaaacccacttcattcttgaaggggatttgaggtgcagcattaatgctggtctcatacataatgacactcgtgttgtagacacttgagccataaggctcgatgaattatatttgttttcttgttttcattaagatttttaatatatgatagttttttttttatgattgcatgatttgctaaacaagcatagagtagatatggagaatgtacacaacaagaaaaagaataatctttgttttcatttatttagtattttttttaaactccagctaaatgctagatattggagacagaaaatacagctatgaaccaaatataaaagaatcccctgactcaagcttgtccaacctggggcccacaggccacaagtggctcaggatggctttgaaggcagcccaacataaattcataaactttcttaaaacattatgagatttttttggtgatttttttttttttttagctcatcagctatcattagtgttattgcattttatgtgtggcccaagacaatttatccttccaatgtggcccagggaagccaaaagattggacacccctgcctgacctcagagagcatagagcccaatggaggaagaaagagaaaagtaagataaagaaataaaatatacactatactaggtggttataagtgctttggaggaaaagtagagaagagaggttgggtgtatgaggaagagggatgtaataatttcataaatttaagcaggatgatcaggcatggccttactaaataaatatttgagtaaagacctgaaaaggtaaagaaagcaagccatatggttatttaggggacaacttttccaagcctagagagcagccgcagcagtccctaaggcagttgaatccctgacccgttggacagcaagaacaccaggatggtgggatagaatgagtgagctggaaaacagtaagatatgttatcagataggtaaaggggaattgcaaatgttaacattgtaggcctggttaaagacctaggcttttccattaagacattaagttatttcagagatttgagcagatatgaaacaaactctgacttactttttatccgaatcagaatctcttttatggctctgaattatatcgatgagctacaaggacacaagcaaggagaacagttaggaaaatttcatctgattcgggtaagagatggtgactctgactaggatggagttgcagaggtacttatagtggttcaattctgcacatactttgcaggaaacactgagagactgctgctagattgcacagagaatatggaagaaataaaacactgaagttttgggcctaagccaatggaagattgatgttgctattaattgagatgtcaaagactaagtgaagatcatgaactcagttttgtacacgttagacaataagtgtctgaaagttgaaagaatgtctggagaagaggtgaaaattctgaagtcatcaacatttagatgatatttaaagccagcagatggatgacattatcaatagtgtcaatagagatagaaaaagacaaggttcaggatcctggccctggagtaatcaagcattaagatgccaggaagatggcaagtgaacgataataaagactgaaaagtggccaaaaacaaaggaggaaaaccaggcaagtgggctatcctaatgccaaatgaggtaagtgtctcaagaaagaagggggatccactgtctaaagttgctgataaagtaagcatgaataaagactgagaagtgaccgttgcatttagcaatgtgggagatattgctaatcttcacagagcagtttagatgaagttgatctaaattcatgttctcttaaatccactccactcagggtgaattcaggctgaatgcctgaacccaggagttgattcaagagaaaatttggggagaaaaataagaacagacgtagccaattaaaaaaacaaacaaggctgggcatggtggctcacgcctgtaatcccagtattttgggaggccaaggtgggtcaatcacgaggtcaggagatggagatcatcctggctaacacagtgaaaccccatctctactaaaaatgcaaaaattagctgggcatggtggcacatgcctgttgccccagctactggggaggctgaggcaggagaatcatttgaacccgggaggtggaggttgcagtgagccgagattgtgccactgcactccgggccacagagtgagactccgtctcaaaaaaaaaaaaaaaaaaaaaaaaaaaaaaaaaacttttgctgtaaagggaaagataaatggtggggtggcatcttggtagagtggtgggggggtgttaatagctttttttaaaaaaaaaagagaaatgtaggtacatattttaatgctttcagttataatttattagagatggaccaattcataatgtaggaaaaataatgcaaacgttttgtccaggaatagcaaggagggatgagatctagaacaaaagggaaaaagttgaccttttctaggaacatgtacagttcatcacagtagaggataaaaggcaataagatcactaaaaataacagccagtttcactgaatttacaaatacatgtgacagccagcagaatttaggcagtgccttcttatttgccattatatattcctagaaaccataattgacaagataaaataaaatatagatagcaactctatgccataagcatagaacctgacacagaataggccctaaagtatttgttgaataaatagtaattatttatgaaatggttatgataaaattaatacatctaaaatgtttgcccttcataatcatttaaaattagcaaaataatacaacagattagagagactataattcttttgtatgtaagacaatagaaaatagtaaattcttttgtatgtatgtaaatagaaacctcagaagttcagtggttttccaatgtcacaggttttagcaaaagttgaagctgaaatccaagtgttctactttctagttaaataccctttcatgtaacctacagtttctggctgataaaatggatcttatagtctataaaatatgctcagtgcataaaaaggtaaatttatagtatcataaatattagactggggatccttaagtaattaaattcagtataattatatgaattctaacaatcatttcaaatttcattaataataatttgtttgccttactaaaacttagaggtagtcatgagaaatatgagaaatgctttcttttttttttttttttttttgagacagagtttcactattgttgcccaggctaagtgcaatggcacgatctcagctcactgcaacctctgactcccgggttcaagcgattctcctgcttcagtctctcaagtagctgtgattacaggtgcctgctactatgccccgctaattttttttgtattttcagtagagacgtggtttcaccatgttggccaggctggtctcaaactcctgacctcaggtgatctacccaccttggcctcccaaagtgctgggattacaggcatgggccactgcgcccagccacaagaaatgctttctattgtccatgtcttttaaacagggtttccagaggactttaatacttcttttaatctagatgaacataacaagatgaagaagagggctcagggtaaaaacaaaagtatgtcattaatgggatcctggtgaataccacttacaaattgtgtggtgctgaagaagttacctaacctctctgttccttagttttattatctgcaaaatgggaatagtaataacaacagcctcattggaatgttcggaatattaattgagatgatacctctacccagtttaatgaataagctgaatttagtaaccattttatctcctctgattccctcaggttaagaaattaatatgaaacaaaatttcagacagccgtcctagcttctctagcatgattagacaataaattaattatcttttgttttataatgaaaaagtctagtctagactaatgattttatagttttggtttgaaataggattataaaagagacacagccctaaggtcccatctaacctaaagtttctccccttacacttggttcaggcttacttcaagccctgaagtctgcactggagggtaggagtctggtggtctctctttattctcacttcacccactcacagcaactgtttctgaccacttcagactcagggcctgtgaaaagaaacttggaggggaaagaccacagtggcatgtggctgacccttgtgtcaccactgtctgggacttctggaatggcaaatgtggaagcaatgaccttttttttcttcttcttctggagtgcatctgtggcattctcaaagaacccctctgtctgttctcttctctggaatcaatcctccaaatttgttgctcataattcaccaccttggaacctgggcttctgcgagtatactcacctatgggcttaagataaccctaagcaagctcccctcatgaggaccgcagttgctcttcaaacattgccaacctttttcttgaccttggagaactatgaggacttgcctgccttgaaactccttcatctgctatatgggcatccacagccactgtggctgcttttagattttagactctatatcctttactctctaaaggaaacctgttaagctctctgaatgtttttcccgaagctcttctcacttggctaaggtgagcaggaactgctctcatttctcatacatggagtggtagactatgtacaacaaacaaacagctttccaaaacaaaagtatttctcttttagcttttccaactcaatctttgtagagtccaaatatggagtttgagttaagacaaaacttactggttggactatatcttagcatctcctgcaaataaagtcttgtgcctcacttaattagcttcatctccaacagagagagagggaaacactcccactttaatatctgggtgcttaaataaaatactgaatggcatagcgggagtgttcagaaatgttagctattacaattaatcttatctttgttattgaacacttaagaagtaactacataaggaattggccacaagaaaaaaattgagaggaataaaacaaaatatttaagaactaaaagagtatggtatcatgaaagttaaggggataagattcatttatccattttttttggagaagcgcagtgtcaaataaaacaaacctactacaattattaattggttattggtgatagcgaacattctgaacagggagttagaggaaaaatcagactgcagtatagaagtcgaaaaaattgagacagtgagagcaagtctggagaataaacttggagaataagtttatagaaaaagaaaaaataagttgaaaactaaagggaaacacagagtcaagggacttttttgttgttaattgtacttgtcatcattttaattttaagaaatatatttgaacatcttgcaaaatagccagcttagaggaaaagtaattgaagacactagagacagagggaaacaataatcaaaagaggaggtaaaagggagggttcagggatttagagataaatattcatataccagaagggcaatgcttaagactggagaatgtaagtaaatgaagacaagtatgggtatgggtaagtgtgtgggaggaaaataatgagcattgaaggacaacatacctactagcctagaaagggaatgtttatggagaattaagagcatgggaatttcaacatgaaataattaatagcattgcttaacacaaagaattcaagggacatggagaatatgaaagcatcactagatttgcaaaatattggtgacatatatgagtgtactttattttaggaaaacaatgatgatagaagcctgattgcaagggttaaaaaaagaaaaagaagcaatgagcaatacagaaagcaagcagatattttatttggccaaaagaaaaaataactagaagagagaaatacacattaagaaaataggatggctataacaggaggtaaaagatggagcatgcttctcttttacaggtaagggataaaacagtgtgctggtattaggtttcacaaaaaacaaaggagctaaattcagttataatcgcagcacaataggaagggatgttgtttgatgtaatcaagggacatgtgtgactggccatggtggaagtggaaaatttaggaaaatttagttaagaactttttaaaaagataaatcaaaatacctttaaaatttgataaagattgaagagagtaaggatttttaatgctctcaatttgtgctagtgttcattattacccagtaaaattgtgcagttaaggttggctaaagataatgatgacaatatctacaatgataatatcagcaacaatagctacatttaacatttattgagcatgtactacctgtaaggcatggaattatcatttgacatattccaactcatttgttcctcataacgatcttatgaggcagtttctattattatttgaagtaagcactttgaccaaggttattgagctagtaagtagcaagtccaattatacctaggtagtatgcattcagaataaaagggctgtcagggcataatctgttgctctctataagatttactcaaatagtttgaattttagaatgtcaaaagatatatatgtcctccataagtagcctcttttaatttctcatcaagatgtacaccagcacatcccaaattatacatataaaaacctggtattttaaaatgctcagggtttctgaaacacattctcatacctcctttcaatcactcttaagggtagatattatttactcttttcaattaaggaaacagagtttgagagaaatcaagtgactttccaatggtcctccagttaacaaaggaaggagccccaattcaaattcagatcttctgactcaagtccaaagccttggccattcaggacattacccatccctgaccattctttctcttcaatagtctttatatttcaattatcttttctagttttctggtcacatttctatttcaaatctccatacttcaccagaaggttatcacaataagctttctctaacatgaaaatgaccaaaatgactcttttagtaacatttgtgtaggtcagttgcagtaataatcccagtgtttcatttatcctgtagccataccctttgccatttaattctgttctgctttccactctctctaggtttggccaagggacattaccaaaaatgacttaagcagaagtttaagaagcatctgcttattcctatttggctcttactcctcttccatgatcatgagaacctgccagggctagcccattacaggattagacacatggcatagaggtgaatggccccagttggctcagccaaggctgtcctggatcagaatcagacaacagccaattgacataaagctgacacagccaaccttcagctagccagtgacataaagttagtccagccaagatcagccaattcaagatcagctgaatcccacaaactcatatttttgtatgttattgaggtttttgtgttgttatatagcattatttaagcaatggataactgatgaatattatgtaatccatccaaaatcaagattgtaaaataatttttcttcatgatctggtcatcagttcaccccaaattctccagattataccacatagaaattcctgtctttattttgcaccacacataataacagcctacgcttcacagccactatatagaacttcactttcatcctataacctttcatcaaacaaatctttttttcattattgattgctatttaatcttttaaaactaaacaaacaagattccccaaagagtcttctttgtacaaagtagggaccctaagcctagcctgggaagcacagcatatgctgaattttggtttcccatatgtccttcagcaaagttctatctgcacaactttcctgccccacatggaatatctcagaatctttaccaatcgtttctcaaaaatacctctttaatatcactttccacatgaaactttttgtagtgaatcacatatcaacttcatagttcaaatactttcagtacttctataatcttccagtactatatttatttgggcccatttatgtattttttccaagcaactctattccctaaactgtctgagagccaaacttttttccccatcccctttacaaacatatgtagctatttaataatgcacagtggaccctcagtgtatgctaaaaaaggtgatgaaaacaaattttaaacttctacatatgacattttgcaacaggaagcacattccctttacctcttctccaaacattcttaacaaatatattaataactgacaattattcccccattctcaaaaatgtgtaggattattttgtcaatattcctagtaaattactctaattatcctaatgattattcacatatatgtatagaaatgatcatcttttagcattctggataaaacaaatgcaagtaattccatatttaattttttatacattaattagtttttatttgcctcatattctttaatcatcacaagttaccctatgaggtgttagtattaaacactttttgtagcatggaaatctgaagttctgactcaaactggtgatgtgtagttgggtcacagtacaaatctgatcttcctatttcaagtttattgttctttctacatcaaaatgcacatatatttacttctccatttactttaaaagccttttttatgggcctagtactttggcagttcagagggttttgcattattgagatctgctccttttctcaaggagcttatagattaggttggggaacaggcacataaacagacaatttaattacaatatgataaatgataagagtaaggcacacagaacaaatgtacttagggttcagaaaagagttcctgaaagagataaacttttggctgggatgggaaattaaccagacaaagacattgaggaaaaacattataggtagagagatgaacattaatgaaggaaaaagaatggagtttgctgggacacaccaaacagtgtcgtattattcaagcatataatgtgacatatttacaacaccagaaatgttaggagatgcagcaaagaatttcagggtcaggtgccaagaaaaacagaagagtagagagatttgagaattatttaagaggtacaaaaagtgtggcccactgaggactgaatttagagaaggaagaaagcaccaactataaggacccttaaggtgcctaagtaaggagttagagcacacttaggttgtgaattggaggtagatgatgactgggtttggagcatgttgaatctgaggttctgtggaacataaaaatggatctgtgcattaataagttagataattgagggcatagctaagaaacttcaggcctggaggtgtggaatgatgtgaaattatcagcactttttaaacgcagatatacccaaagacataatgaaaaactaaacaatacagctataaaataatttacatggttaaaattgttaaaaattattgttgcatacttttataaagaaataataggagagaaagtgactaaagtaaagctccaatcaccaagacctaatagcactgaataggcaatttaagacatctatgtcataaagtttatctctgctttcaattctaccctgtgtttgctgaaataattttcatttttctgttaccctagtggttttcaattttacatgctttatttctgccccaaaagtcacatttatggtagttattttcaccttccagctaaatgtcaagtgcaatgccaccaaacagtggcacattatttacaaaatattcataaagtttcaacaatagcaattgatgaagaatattcctctattacttatagaaaacttatagccctaaagatacagagtaggttattaaacactttctttaaaaaaaaaagatgattatcactgtctaaggacctgtggatttctaggggtactcagatatttataatagcaacatacaaattgatattgaaaaagatatcctcaaagtatttttaatttagaatggaactatagccatctaaatgtataggctcataatccctaatctacaattccaaaatccatacactctgaaattgatatttgatttgtgaatatgtaatgaatttgacgggtgggaaaatcagacctatacttatcatgagactatttacagtctttttttttttttaccatgcagtaggaatattcatagaattatcttcagaaaaatttcagaaatattcagaaatatgggtgctgcccatagtccttcaggaggattgttctataatatgctacacacacacacacacacacacacacacacatatacagagagagagagagagacaagaaacagagagtaagagagaaagagagagagagagaaccagaaaacttctgagctccaaaacataactggtcccaagggatttagataaaaggctgggcagtatatttaaaaattaaaacttaacattttaaaggcaatcataatttagatactccatacaattgaatagctagaaataaaacattttcattcttgtacctttacaaagagatttacctccacaatcagttacgtataaaaatatttttcagttttctcctttttttcctgaagtatcttgttctagtgctttatttttacaacatttttaagtaaaatagtcaccttttttttacagaagaggaaacatttaaaaatccaaattactttcagatgtattttggtaagattgggatttaaactgaaaacttcaagcttgaataaaatctagaaagacaaatgtaagagggattcatgcagtcttacatgtaggatcagaatcaacttccaagaagagtggaagggaaatgggaacacactgcagcatctatgcaagtcaattagaaacttcagttgactgctgtcccagtacacattgaaggtatgttgaacttgtctccaaatataataaaatcctagtgtaaactaatgaaacactgtatccagaagaagaaatgattgccccattttccacttgttacagtagataaggaagagtgtgactggttctgggaccactttaacaagagaattaactaactcaaataatcctccaagagagtaagcaggatggtgatagttctagaaatcaccttatgaagagcaattgcaaagactaaaatattttccttaaaaaatataatatttggtgtagctatctagctgccttttgaaatgagtcaaaacattttgtgtgatgacacaaaccagggtaccaagaagtgagagttattaaaaacattatttcatctcaatacaagataaactgcctgaaaacgaaaaggactagaatggcagttattcacacagggttatgggtttacctatcaggatgtgacaggggattcttagtgatcctttccattttgagagtcataaatatctctatgagttaatagtacagatagctttagaattttatcaactttgaatatatagttttcaatatttataaagatatctttgctacaagccataactttgtggagagaattcaactctttaacatttagtatactgtcttttaaggagcgggccaatcaaccttgtatttaaaagaaagttttagtttaatgggggtgagtatcaaaaatcccattcatttttatgtttcttctcatacctaaaagaggcacaattatgcttttcattttttttttttttggaggtggagtctctttctgtcccaggctggagtgcagtggcgtgatcttggctcactgtaacctctgcctcccgggttcaagcaattctcctgtctcagcctccccagtagctgggactacaggcgcatggcaccacacccagctaattttttgtattttagtagagatggggtttcaccatgttgcccaggctggtctcgaactcctgagctcaggcaatccacccacctcggcctcccaaagtgctaggattacaggcctgagccactgcggccagcctatgagtttcttaaacaagtaaattgactttcatcattaactttgtatataaataggctggcagttcttaaaatatcttaggattttttttttctgtaaaatacaaagattgacagaaatatatttaaatatagctaacaacgttaagttagtgaggcttaactttttccctttcaccaatcttcaaaatgttttaaaaataaaaagaaaccagttaaagtgtttttttttcccaagggagaggataatatattagtaattccaagaattttaaagcagatattaggcatttaaaaaaaaaaaaacaatagttggacacgagacttccaaagtacggtcattttcaaagaccacacaactgaaaatgaaaaatacatatttccaaatgtcaatattgtgtttaaaaggtaagaaagataaaactatctccacattctggtcattaaaagctgatccacaagtggttttctacctccctaaaacacataaatacaatttttaacaaagactggataagaactcttgcttctcacacaaacccccaaccaccatcagtagtccatgattttgtttgaggcaaggtttcaagtgaactaatcatctattcctaagttgttctcaccaaaacgtgtgtatcacatatgttaagtggaaaagtaacattaagaatgggagtaaagtgaatcttaacaaatgttcaattacaataggagaaacaaaggctaccaggaagcatacctgtggcagggctgaattgagctgtctctggagtgagtctcggtcatagatgacatcctgaagtctttgctgggcaagtgagaggctttcctgggtctcccgaagggtgtctagaagacgatccctttcatctagcatattcaccatcagctgctcaaaatgggagtctgagtccgagccactgctttgggaccccctttggctcattggggtgtcctcattaatcgtgggcatcacttcacacatcattgcttaaagaaagtaagtgggaaggagtcttagtaaagaaatgatttccaataatttcatttggagagcaattcactaaatatttttcagcttattagcctatttgtctctatttcccctacctgttgccccaaatccagccaagcaaaatgttttgacctcaatgaaatatgatccatttacttccttcagcctaagtgctttctctttccatgacatcacatttatcccacctcccatatgcaacttggtttcacctgtttctcaaaattgttgttcatgatttatcccacctaattcaatttacataaacatgtgatttctattattatttcatcacctttcttatctgcaagtttacaaatctcttacagcgaatacttttatgttacccttatttgttattactgtatattattaatggcaagcacagtgtctggcatttaacgggtaggaagtaaatgacttgaatgacttaggtaattcaatgatttaaagtttactctttcttgtagaaaatatacaaatcattgagtatttattttatataataatcagcttttactttgttttttagtcaaccgatttttttcaaactgactagttttaagctttctgacattacattttccattttattacttttatatgctctctccctgaattcctacgtggtctacccagagcagataagtgatactgactgaattagaccaaaaccttatgaaataaactgaggtatataaatttgtttagagcattatactcatcattacacttaatattccctttttcctgttaactgcatggtctggttttcatccaaacaatacaaactagcactctttcaaatattccgcaaaacagatgtcataaattatattagctaatgtagtaacttcacatctcaaccgccaatcacaagttctcagtcatgaaataaacgaactgttttcagaatatttttaaatttgatttaaaatagacaaaacacacttaggtgcatgattgaacaattatgtggcaacttaaaaatcagaaattatctcattttctctttcatcctctagctaatgtttcaaagaaaagtcaaactcatctcaattttggttgttgtactatggccagcagctattaattagatggcttggttttgcaaaaggctgatgtaaagaaaggcaggtttggctgttgatcctgaagcactgtttggttttataatgcaaggttaattaatttttctgcctatacattcctgtccttggggaaaatatttctggtgatattttcaaatagaatgtcaagatttaacagctcaatatttaattactttttatgtgagtcttcatataaattgggttattgaggagcgaaattcaattatctgtgaatgatctggtcagggactcctgaaaactaagaaaaacttttaaaaagtatgtaagtaaagtattttgtgattgataacctatattaaaaaattaagggggtcattgaacattaggaaagttttaaacgctttgaagttttgctcattgctcataacactgagctacctgaaggcaggaatttaatttgttcaattttgtatgcacactaaaatatataacagagaacacacataaaatgaatataagcacatacaccctgatacccacacttgatactactgttacacacttaatggataaaactgtttcttgcatttatctcaatttgattttcattcaaagactatcacaaagatggaaaatacagactctttttagatgcttcaaattttctttatattaattgaaaaggaattggaaaacaacaaaaagtgttccaacacatttgattatttaaaacgattagttagcaggccatgcatgaaacctacacattgagccgctatgtcattctgagaaatgattaccaggagccaatatgtttacttttgacatttaaggttaaaacaaagtactgggagagcaaatcatagcatcatgacaatttgtgcccaaacactcacaacgttagggttacctatagatttaaattcttaaatctatattttaaattacgtccttcttgaatgaaagttattaatccctttccaccctgaatcactcagaacaactttaaattccaaggcaaagcataacagcagtgaataccccaatataattttcacctgaaaataatatcctaacaatccctcattgttaccatgggatataaacattcacaaactttagggtcttaaatcaacattaaaggtagtcttcgatttagtcaaaagatgctatgatgaaaagtggcttagggacttagaaagtctattaaatctacactcaaaagaacttgatttgattccactcctaaggcaggtgaaccaggacaagttactttacatgttaaaactttagttctctctttcatgaaagagggccaataatctatgcttagaggaaaaaaaagaaaatatataataggttacctgactgagaacacacagcaaaacatataaagggcaattacaaatgtaagtattaatttctattataaagtgatcaacattaatctttgtagaaacaatattttacctttacgactcattctgctgctgtaaaggtttaattctagtagatacttttgaactcttcaaatccaatttataaaaatcaaattatgcaaaatttacttaggaaataagatgaatatatgctgcttataccttgcagtcaacccaaatgagtaaatccaaagtcttcttatcaaaattagaaaaaaatagtctacaaaaaaataaggccactttcatgaactagcttagtttctttcattagaattcagattctaacataaattacaaaatatttgattaatccttaaaatgcagtataacatttcttaaatgcacattttgcacattttaagtattaaaagcaattaaagatatatattcaatataagagttaaacacccttttaaaaaatggatgacatctgaagcagcttgcacagtccggaaggctatggtcattcaatgtctagtgcgtttcacccagatacatcacttttaacttttataatcagtatcaatactaaaaactgcattcatcacataatttctgaaaagccagaaagggcattttaacaatttgccttgatatttgctttttcatcattcccccctcaaagtcaatttgatatataaattatgttatcttcatctagatattgatgctttcctcattaaattactgaaggttttgaaacctagtcagagacattgttaattttgttgagaaagaaaaaaagtaataataaatctgattggcttaattatcccagtgcttaaatttagccggaagaattttatatcaggaaaataactcctttattcttagcacatagccttgactgtcttttaaatttctcagatttcaaaataaaagtttgaatgcccactggagtcctcactcaagggctttcaagatccaatgtgttccttaacaatatatgccatccaagcagtacctcttcagatatgagagtgctacaaaaagctttttttcttttttctgtcaacaaatgactttatttaatcatatcactaggaattcggccctactagaggtaagaatgtaattattatccatagtgagtttcttctgaaaacatttagtcttaagaaccatcccagctccacctcagttaacctacaaggagtaattcagtgagagaaatcctagccattgtctgattacattacatgaatattctccctcctatttaactctttgaaagcctctgtcctcgggaaatatgattatcacctttaatggacacattttacactttctttaccctagtgcatttacggacagccagagccagctcaacccacactactggacagttatctctcagccacaccccccaccaccttgaagaagttgacttcatcatttccacactaaaattgttcatcctgcccaacaggacacagccaagtaggcaggaggtagagagataggagatggagaggatgaggtgaaagcaaaaggcacctaacggtaatcaacaaggaggaatttgcatctcatcttccctgggggcggggtggggccggggaggtggtcaaaaaatacagcgaaaggagacagtaaaactcaaagacagcttctgtacctaatgtctgtgatttcgggtccttgcttcttcaattgatcaatgacaaccgcagtctccggcttgaggagaagggaggctcacacccagcactcctggaccatttccctagcaacgggaggagaaaggcagctcagacacacgcgtgccccggcgccctcccggaacgtgccccggcccggtggcgtggcaggagctcggcatcttcccgtggctccgtcagcagccaaaaggagaagcgtccatcggaaaaatggcatattacaaattttgctttgggaagcaaagctcggttcagaccattgtcaaaggaggagagggggaggcggctcttaaagcagccgcggcccctttgccagaacagccgcagctccccgcgtgcagctggagccccggggcggagaccggagaccggggactgggtttgactttcagaaacttaaccacgcggcgccgctccccctccgcgcccgggccacccggggtgtgtggggcgtccctccaaaagaaagcttggagaaaaggcgtgagaagtatctgggagagaagttctccacccagtctcccctcctggagcccctctggagtttaaggctaaccctgggagttagaaacctaaaggaaaacgagtccctagggatgcaaaaagcaggacaggtctcctcctggcccccagcctgtttccgcgcgctcccgtgtctcgtttcacttaaaggaggcgctttttctctggaaaggcaaacatcaccccacgccgtcccccggccccccttccctcccccccgccgcccccccgccgccacagcacacacacccatttttctcctcccggcctttctgcaagcctctttgcttgcttcaattggccggaagaaccaacctgctggcagccggtgaggacgctacagcatcttctctcctcacttgcctc

SEQ ID NO: 447 - DNA, 340107 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttctaaactttgtgatgctggacccagcctaaaatggaatttttctttaatctaaattctaatcttcctttaaagttaactcattagtttttattgcacttaaaaataattttagcttttctcaaaaatgtttaatttctaaactttttattgcttatttttatttcaaaatatttggggttcaggtggtttttggttacatggatgagttctctggtggtgatttctgagattttggtgcacctgtcattcgagcaatatactgtatactcaatatgtagtcttttttccctcactcccctcccattcttccccacaagtcccaaaagttcattacctcattcttatgcttttacagcctcatagcttagcttccacttataaataaatgagaacaaaatattgtatttggttttccattcctgatttacttcacttagaataatcaccttcagcttcatccaaattgtagcaaaagacattattttgttcctttttatgcctgagtagtattccatggtgttaagtaaaaagcttctgaacagaaaaataaataatcagcagagtaaacagacaacccactgggtaggagaaaatatttacaaactacgcatctgacaaaggaataatatccagaattgacacagaactcaaccaaatcagcaaggaaaataataataatcccatcaaaaagtgggcaaaggacatgaatagacaattttcaatagaagatatacaaatggccaacaaacatggaaaaatgctcaacatcactaattatcagggaaacgcaaagttaaaccacaatgagataccaacttattcttgcagggatgtacataatttaaaaagtcaaaaaacaatatatgttggcatggatgtggtgaaaagggaacacttttacactgctggtgggaatgtaaactagtacaaccactatggaaaacagtatggaaattccacagaaaactaaaagtagaactaccatttgatccagcaaccccactactgggtatctacccaaaggaaaataagtcattatacgaaaaagaaacatgcacctgcaagtttacagcagcaaaattcacaattgcaaagatatggaaccaacctaagttcccatcaacccagtggttaactttttattttgaaaggattttagatttatagaagagctataaagatagtacacagagttcacatgtacctttcatcctctttcctctaatgttgacatcttatggtatgttcaccatactaagaaattaatatttgtgtaacagtttacttttatttttaaaaatgattttatgtagttttaaaaatctatgccacttgaaattggtcaacaatatataataaagatagaacaatcaggcatacataggtgggtaacctttctctgaagatcattgtcataagaatgttttctctatattttccattagcaaattatgaagtgaatccagatttgtcatctatgacatttaaatggcaataaattagcagcctgatttataaatgattttcctctcagtgccagaattaaactgcattgctctacaaaaatgaacaagcaaagaaaccacaaagtcatattcaagtatttgttttttatctttttgtttacccatatgattatttcttgaattaatactacatgagcagattgatttggaattgttacaacagacaaaaaatcttttatctctgcctcactagaacttccagaatttaattaaaatttattcattgattctgccctcttctatcccagtcaagttccccccctgaacaaatacagtatatagggtcagtgcaatgagcagaattgctcagaaaatgtcctctctcctattaaccttacccacatgtgaacatctactgatgttagcatttaaaacaccttatctttcttttattctaaaagaaaattaatttaagtaataagtaaaattcagaattaaggtcttcactgttacattctatcatagtgcaattcacatattaagttgctaaataatgacaacacctgtaacttttcttctgtaatcatctgagcaaatgaattaactgtaagttaagttactttattttgacacttctaagagtgctttttttaaaattaggattttcatacatgtaactttaggacatttttggaggtatgcactgtcttatactgtatccacatgcaagtaaactcacttactaaggctgaaattagaaataaaacagtttaaggaaatttggtatgcttaaatcatgcaattctgatacaactaaatgatactttttttgacacatatgaccattcaaaataattacttttatacaatgataaagttgatgtctgttttaaaaattaaatatactaaattatcctgcatgggctacctttattccttgtttaaatccactgtgctttccttgatacaagattggtagaaataaattaactcatttattattctatgacattttatcatttaagctgtcacttatgcttttattatagagaagaatctctggtggattcttagagactttcttcttatccacttttttgcattccttaagtgttgttttctgctattatattcaatctttaagatcatatacagctaaaataaatttaatgagagagaaagtatgtgtttctattactggcattgccgtgaattttatatcactggtttgctttggtatttttacactgaaaaatgaagatacataaaatcatcataataaaaaacaaactgccaattaaaattatactttatttataatgaacagtatttgagaggtgctgaagtaactaatgctaattcaagtaatggggggtacaaggttacccctttctttcctaccagctacatgtaccaaagagtaaatcaaaagaaacctttcctgtaggatagaaagcgtgctgtgtttctgaaatcttgaagattacccaacatagatgtaaacacactctggtaaatgcaaataacatacaaatctaaaagcatattatttatattgataaatatgctgtgtttacacaaattaataaaaatgtaaatagcaaaaattctaaagattttgctacaattattttagctttatcatcaatttctctttctgacttgggtttggatttagctgctcttcaactactctgatggccagtctaggctactgaagactatcacttgctttattcatcagcttagatgcttatactacaccttctcagtgagtgtcatctggatgttttaaagtcaactcaaattcaatgtcttcaaaacttacctcccccacattttctctttttgaatattgtttgataaacactggattatttaacaattctatttttcaaatcagaaatctgggagtcattctacattcatttttctcatgagtacatccagtatatcaccaaagcctaaaacttctaccccaaatagatttctagagtctcactcttttctctcttttctcacatttgatcatctcttaccaaaactctttcttgaatttccactataccagcacatcatatacttggaaagaccttaaactcccagcatgccaaatttttttttttgtatctcatggtttaaatggttttaaagatattatattttttccacatggattgtgggaattaaggaaaagatgttctccaaatttataattcttatatagcttttctatttggggaagagtagaagagtggaaaagcatattggatttgtttcagatagattagttttatcatttctaagttcaaataatgtctttatgcttgtttaaagttggccaagttattgtaactaccaggagatagattctacttatttgtaagaggaggataattcttcctgaaagagttcttgttgagattaaatcagatgtaatatataatgttcctgtcttcatttatcaactcttctatccacttagctttcagttaccagacatttccaattataatttgatatataaaataaaatttcactttgttgttatgggttgagttgtgtcctctgccaaatatgtcgaagtcctaaccctagtactttaaagtttgaacctatttggaaatagggtctttgcagacgttaaaaataagtgatttggttgggtcctaacccaatatgactgtgtccttataagcaggagaaatttggacagagacaaacacatacacaggaagacaatatgaagacacagggagaggtcatctacaacacaaggaatctgaggcaatcaaaagttcaaagaatggaccagattcttgcaaagagccttcagaaggaactaaccctgcaaacaccttgattttagacttttagcatccagactgtgagataacaaatttctgttgtgtaagccacagtggtacattcttatggcagcctcagccaactaataaaattgttttattatgttttatataaatgtgcccattcttatgttaacttttttggaaggttaactaaggaaagatctgaaccagaaacacagataacttgtcatatcacttagtgaagtaccccaggaaactaggcaattcatgaaagatgttgataatcttagacatgaaaccaagaggaaaatatgtttaatgaattgctctcgcattctgcagaaccaaagagaaggcttcatgattaaaagacaagtaaaataaaatatgcagcatttttccttaaccccacattgtagcttttttttttttttttttggctgttttgcattgttcagagctctagtagaagacaacagaatccactcaaactagtgggaaatttgtcacacatgttaaatgtcttaccgaatcactggtagggatgattaaatagactttaagccaaacatttagtaactaatcctaaagctacccggcagaacaaggatccaggagaattactgtctcttccaaagttaggaagtcaccagcttcagttctccaccactactgcaacgatgaggaaggatatgtagctgtagcagctccagaaacccagcatgtcttctacagcctgcaccagtgaaaatcattccacacacttctcaagatcctcaaagttgctgacgaggtgccgagacctcggctaatgctgccaagaaacactccacatgcctttgactgtgcttgttggcagatagaacaggagcgactgaaatacggctatctgagaaaggttaagattgactgaacctccatcacattgagaacactagttgcaagagaatcttgaagatgtagattgtagctttccatattctgcaattcttcaaggaccattaaaaggagattggtatggtgttgagcaccaagccactatactcaccaaataacacagaaacgttggttagttatgaaactctcttagttacctgatgcagcctcgactttaggaattcttactattcattaccacatacaagctattagcctttctctttcctgaaaacatacagttttgaggctgctactctcaggtgacactgcctgctacctttccttgtaataatttacaaatgccccagattggcctgtcgtggggtggggggagggataccattaggagatacacctaatgtaaatgatgagttaatgggtgcagcacaccaacatggcacatgtatacatatgcaacaaacttgcacgttgtgcacatgtaccctagaacttaaagtataataaaacaaacaaacaaaaaacaaaacatacacacaaaaaatgccccagatttacttccttaaagattttaacacctggatcatggccaatttcactattccagtcaaaattcttgatgatccaataccaacatggaaggatattgaccatctcttttacaatgacttgatcctgaatcatatctcagccatctactttcaaggtcatatctatgtcctgctaataacaacaagtacaccccaattccataatctcaaccttaaacatctcattctctatctactagttttctctatttccaatgcttttactccctcaaatagccaagattcagtaattcttcaaagctaggagtaccaaatccactgcagatcactcctccacgctttctcatgttctcacctccctagctattcatcttagatagtacaacccatcatggtaagcactttcttactgacaccttcacctttctaagcatttagctattcatcttagatagtacaacccatcatggtaagcactttcttactgacaccttcacctttctaagcatttctttctcttccacagaactccctacaaactttccctgccttatcattttttataatatctatctatctattaatagttgcctcttttcctacttggccataatttccacaagggcaaagactcttctgtttattgctattgtctcagatggtgaaactgtggctagtatgtaataagagctcaataaatatttactgagtaaattaatgacataatattttaggttaactagaatattgtccgtcaggttaaagctgctcaaatattttactgaataaatgagtcatatagaataaaccctaagataaaacaaacctttaaagcctatttgatctactcattgaaggtagaatgaaaaatcaattgtgtaaagccaatgatatacaaaataaacaaatgtattctattctttttgtcatataacatactttgaaacttttcttccctttttaaaaacttttcctcctaaatctcctaccttttaaatggaaattacctcaattaaagcaacaatatgattttcaaagattaaaaatatatgagataactaattgaataaactcttacattggtccattaaaataactataggttatattaatattgtgctggaactgattatcttcaaattgattctattctcctcaatctgtctttaaggaaggatattaaaagacttgaaaatacttaaagactaattttaatgctgtctttcagcagtcacaatgtagttcccaaattattaattacatcaggtaaatcaaccatgacaagctattaataggaaatggagaagaaaattacattagtaaaaactatttaaactgattatctaattatagagagacccacattacataagcatgcaataggacagcctataggggtacagttagtcgcaggtctgtatctttgactgtttacagtgatgtcgcttccgctactataatgaaccattaagtgacctacaatatatcaaatggcatggaatcgtgtacttaaagaaatgtctcaagaccttgtttaactaacatgctcctaaaaccttcacagcatttagctatagaagcaaacaacacaaattgctattcagaacttataataacgaagaaagattaattttaaaatggacttttcagtttatatacagtcccccgttatccatggaggaatacattccaagatccccagtaaatgtctgaaaacaggtagtaccaaattttatatatgtctttccctgtatatatgtacatgtaataaagtttaatttgtaaattagacacagtaggagattaacaaaaataaaataggacaattataacaacatactctaataaaagttatgtggatgtggtctctctctcaaaaattatcttactgcactgttttcacacttctccttgtgatgatgtgagatgatataatgtctatgtgataagatggaatgaggtaaaagatgtaggcatttaacactgggttacttggcccttctgacaatatgtcagaagaaggatcatctgctttaggtgattctggatcactgatctatcatgatgttgatggctggatgtcaggagtagatgatgttgatgcctaacgcgcaggtagtgcagacagcatggatatgctggatatggggaggattcatgtctcaggcagaacgaagcaggttggcatgagatttcatcacactactctgaatggtgggtagcaacttaaaacttataaactgtttatttctggaattttccatttaatatttttgagccgtacaactgaccttaggtaaccgaaaccacaatactgaactgaaagtgaaactatgaatatgtggggactactgtacttgtaactcacaaagtatgcaataaacacttgttctttccttccttcactttgattctttcttcttttcttcttcgtttcttcttttgacatatattacttgtcacctactacatgtcaggtgctttgacatgtctggcagaatagtacataacaagacagacaaggtgactgagatctgaaggataggaagtagtcagttaagacaacagctgagaggaagagggtcaggaggtggtgaccacccttcctgagagcatccccacacacttctgttggtaagaaatgcatggtatattctaggagccagggtgctgaacacagaatcagtgacagtgcatgtgtcaagaggagagagagagtaagtaggcaggatttataccatgcagtgcctggtagcccaggaagagggtttgttcctattagaactgcaatgggaaatcattatagcagatttttttagggggggtgaggaagggaggtgtcatatgatataaacattgtaaaacataatagcagaaatgtctatttatatgttgctctattttgtatatagtgctagggaatcatataattccaaaaattatgccatgtttttacaaaagtgaggtcctaaatattcacaaaagaatgactagactataactcaatgattagagtcaatggaatacaatgcattcttgactgtttctagaaatttcaggaatcacgagaaaaaaaaaaaaagtgcggtgtaaagatcgctaccaaaagatcaaggtgagttttgagccttctgcatgccctctttaacagcccctcacaaatgcagtttaaaatagtaactgtcgtgagtgataacttgacgtatttatcatctaattgagctggtgatggtttattctgatatttactaaacacttattctttggaaacgattcatctgcaatgtatcatccacagtggtaagtacagtgtacatatgcagtaagtgcaatatactaacattttcttatttgagaacaattttgaaaagtaatgtcatccaaaggaacagtgtttgaagtattcatagccttttgttaaaatcgttgcccagcactttgggacgccgaggcgggcagatcacgaggtcaggagatcgagaccatcctggctaacaaggatctctaataaaatacaaaaaaaaaaaaaaaaaaaatagccaggcatggtggcgggcgcctgtagtcccagctactccggaggctgaggcaggagaatggcgtgaacacgggaggcggagcttgcagtgagctgagatcgcgccgctgcactccagcctgggcgacagagcaactccatctcacaaaaaaaaaaaaaaaaattattgcacattttttgtaaaaatctatgatcttgtattatgaaactaaattgcatccaggactgctcaattttgtttataaagtttacattgtagattgttacataaaggattaatttttgcaattgttctttttccaaccaaacatgatcataaaatgcatttacctattggaataaagatgaatcaaataaaatatttgaaataagtcattgtacatatacttgttccataatagctttttgaaagtattaaatctatagatgtgaaagaagcaaaaatataaaaaatctgaaactggacaacaaacattcattatgcaagatatttaaagctagctattgaattgcttcaaaataatttgttgtaggctactgttttcttcttgattccactgcctacaccttaacagggaataaataaatactctcctatgtgtacaaacaccttctttttagaaatattaaccatctactgtggattttatagatacactacaatataaggaaagttggatgcaactacatatgtcttgcatgatcagaaaaatatgatatattaaaagaatattctttctgaagattcactctctgaaaaaaaaagttctaaaagggcttatacagagcgatttaaatacaaaaatttgaatcaatcagcactacatctctgtaagtatacaataggaaaatttctgaatgagaaattacacatgctttctgtcatcaggctcctgctagctcagtgctataattcatcctacactgctgcaaatatatctttataaaaattacagcactactactaatattttgtgcttcatttcaccaaattttaacctaatcacttccctgccgtccaaatttttcctcagaagcccttttccatgacaaataactcttatctaccttgattcttcacagaacggtttttctccagcttgctttgactgcaaaaactttatttagagtgcatcactgtcctatgatcctcactcacagagacaatattgtgtattggttaaggtagtggtagcttctgtaacaaataaatcctgaaatctcaatagaggtttttctaattagtggactgggggaattttctccccacattcactcaaggacccaggctgatggaggttctgccatctttaacatgctgcttctagtttgctcaaaggatcaacactcatctatcagaggattacatgagattgtttttttggccaggccagaaacctatgtatgctaatcttgccactatttcattggcgataaatctgtcatgtggctgctcctgacagaaagggaggatgggatatacattatagccaagtgcccagcaagaaagaagaagagttttgctaaatagctaaatagtctctcacagtcccacagacttcacatatactaggcacaggagtttgttagcatttttctagttagtaaatagttccttattcctaggacacttgtacaaactacatcttccttagaattgaccaccccctatattcttatccctgtgagatgttttaatcttcacatggttgacccattccaaaacgtatcttcctaattaaaaacacaaaagtatttcaacataaatgttctttactgtctacctcttctgctagtcatattcaaggacatgcatgcacctcacttagcacatttttgtcattagaacacttgaattattattaattattgaatactccatcctttttttcatctacatgcctctgggaaatattatttcattaaataatagaaccctctaataaaatcttcactaaactacccttctcattcctgggggtggtatctgtacactgtgctgccaaaaaaacctagagcttacctctacaatgtgaggaacgcttagaacacgaaaattttctactaacttaacaagacctaagactaaacttttccacccatacttcttgctaaactcaaattaacccaccaatagctgctaaaccttggtcacagtcttgctttttttacatctactaccatggttaatgaaacatcagtttgcccataccttccaaaaatataaacaatgaaaaattcttagaacaaaactgaacctttagaactttggaccatctaattacctagatgcctttccctcctttatctgtcttacaaaagttctcttattttccactaccatacttacatgttacacattgtatgatgcctctgctgcccccagcaaagctgtgggagtgactacctccatcttgttttcaaaggaagtcatgaagaacatcagtgcccaggaagagaactgccatgagggtggggtcacttcagacagtccccactgagtcaatgcccagtggagccatagggttggttctaccctcaagaccttagactggtagagcaaccagagttctattccagcacagaagagctctggtgtgggccgcacccagcaaaaccaagcagggatgcctggagccctggagcccatttgcccagtaaagctgagaagatggagcctctaccccactgtgtccacaaggagacctctgccccagtgggcctcaagggcagacaactgagtcaaagaagattcttccacaacatttatgttttggacttgttcaggacctatcatttatttcttctttcctatttctttattttccagtgggaatgtctttccttgcctgtcccaccattatattttggaagcacataatttgttttatttcactggttcacaactggacaaaaatttgcctcagaatgaattgtatcttgagtctcatccatatctgatttagataatatttagatgagatgtgaactttagacttctaagttgatattagaacaagttaatacttttggggtaattgaaatgaatgcattttacatttgagaaggacatgcctttttgggggatggggcagaatgaaatggtctaaatatatccccttaaaattcatatgttcaaaccctaacctccaaggtgatggcattaagaaatgaagcctttgtgaggtgatgagctgatgagggcaaatccttcatgaatgagattagtgtccttattaaagagtctgaaactcctcaccaattaaagctgccatatgaagttacagtgaaaagacaactatctatgaaacagaaactgagtccttactagacactgaatttgagggtgccttgatcttggattttcaagcatccaaactgtgagaaataaatttctgctgtctataagttacccagttcatggtattttgttataacaactcaaaaggattaagacacattccttaataattctctacccctttagatagagtcaatttggctcctgtgatggatagatcctatggacaaggtcaagacactggtattttttcctctggtgttcactttctatacattccctcttatgttacagaacttgtgatttgcccctcaccaaggtgaagaggtgaaaagatttttgcacatgtaatgaaggtcccaaatcacttgcctttgggttaatcaaaaggaatattattctagatgaggttgactaaaccaggtaaaagctcttttgaaaaaagatatgaagcaccctgcaggtaagggaaatattcctgctgaacttgaaggaaagtgtaggtaacccctaagagctgagggtctcagtactacaatcacagggcctaaattctagcagccaccctgtgagcttggaagagggctctgagctccagttgaggactcaaatctggcctctgaaactttgagcagaagactcacctagattgtgtctagatccctgaaccaaggaaactgtgataatgtgtgctgtcttaagttgctaaatgtgtggtgatttatttccaagcactggaaattaatgcagaacccttatatatgttctccttatattgtttactaactccattacaacactggacatgaaaaactgttgctcatcagtgactttcttcccagtgagattccaaattccacaaaggcaagaaccatatctcatttataaaattcagtaatcagaacatattttatttttggctagaataatatagatacacaacaaaattcttagaaattttcccactattctagtctaagtaatctagtcattggttaaaaaaaaatataaaattagaaaatcaaaaactccttattaaaaatccaggtctcaggtctcaatagcagacattgatgaatccttttttcctttccaagtacttagatattagactaggtatttagccttttacatgcacccctgtagtttaaggaaagccaattaatctcctaccttcagataactcttttagcttgagacagcattttttattcccctaatctcaaatgtcagcatagggatgtgatttcagtgaacctcttacttggaatgccagaaacagagtggtctttttcctgatagttgagaataagggtgcatgtggccctgattgctaatgcaggccaatttgtggctgtgagcttttgcctgtttggggatggaaataatatcatgaactgaagagcagggaaacacaatcaattgtgtttaatgacatgattgaagacctgtaccaccattgctgaatcctgccttatttctggatttgagtcaccagtaaatctctttactgtttaaagccagtattagctgggattctgttgctttaacatatagtcctaaatgaggccatttctaaaactatattatcaaagaatcactaggattggtataaagcaaacatttggtcattcaactaattatttacaggatgtcaaatagctgaatggacaactttgttaatacatcctcatattttatgattgtggaaatagaacactatgactttttagattaatgttgatttgtaaagatagaagcaacaaatttttaaaatatttaacatttttgcttagtatttatctctagctcctcaatacccagtggttctgagtaggtttagtttgcatatcattgatatctattttaattggtagatacagtcactcatatattagaattctcataacagatttgtacctatgcttctagctgaaggtatgacctaaaagttaaaatacagaattattctctgggagaatttaaattagcctttgatcagaacaaatagggtcacataataccaataccaagatggtgggaacttcacataattgtaaagtggtgatggcaaggaggattaattttgcaaaatccatgccaatgatacaataaaaatattcgtgtcttaatttagtcattttctttgccttcaagaattcagctaatcaatattttattttaataggtgtcagcactgtaaaagtaagacacagaaacagaccaagaaaccagcattgggcatctgatgcatcattacttttctttctttcctgaaccattcccaccatgccacaatttcaatcatcctaagaaaacatattattaatactctcatcttccattttctaacactaggtatttactcctactatatacaccccggggagctccattttatgcttctgtttagagtaaaattctttgaagaagttgtctcttcattgtattgacttccacttttcttagtctctttcaaagccttctgactaatcttagcaaggtccacatgaacacatcctcccctccccctactcaaatatatgcatagttccttctttacttccttttttgagttttatgtccaaatggaaccttctcaggcaagcctttcctcataccttcggtgttccctgctttatttttttctttagtgcttaatgcttatttaattacaatttattatatatttctgatggactgaattcttatgttccacccaaattcgtatgttggaactctatcacctaatgtgatggtattaggaggtggagtctttggaaggtaattagaattagatgatgtcatgagggtttagtgaccttacaggagtcctaagagagcctgcttcctgcttccatcatataaggacacaaggcaccacctatgaatgaaaatctgctgggctttcaccagacaccaaatctgctgacactttgatcttggacttcctagcttccagaattgtgagaaataaacttctgttgtttataagctactcggtttatggtattttgttgtagcagcctgaacgaactaagacaacatttataatcaccaccaatcactcctactagaatgtaagttccatgaaagagggttttttatttattctattaacctcattatttcagttcctagaatagtacctaccccttagcagatattcagtatttttttgaatgaatgagagagtgccattgatcaagtgagcaaaaattagggcagtcaccaacaatagacagaggatctgagggtacatcttgaagcagacagatcaattaagagaaatcaagaactcagatagtgatatgggtaacaagaattcagaagcgcaacaaaatgattaggtaaaatgcacagaattccatgttccagaatagaattaggtaaagtgtcagctttctactgaagaaaatatccgtacgcactttatatagtctagagactgaatttatttcaaacctggctgatttataagtggaatcaggcaaatataactaacttctaggtatgaggggaaataaaacaagttcctgacaacagaattggctttctattcaaattattgagtacatgtgttcatccctaagcagcaatgctttataattgtctatgaccacaaaatataatttaagttcacgaatttataaatatatttactaataaatacacagaaaaataacaccaatattagaaacaatctacaaatgtgttgtgaaaagcatttccatagcaacatcagaataattatcgctataatcagcagtagagaaaatgtgctaaagccaagctttatttttctcagaatcatgggactgcagtgctcacccacacaaccgaatcagcagcatgaaaaacaacagaaaattatattttatgtataaaagagtaattgagcactctacaattatatagaaatcaatgagtacaaaaaatagattaacagctatgaaaagagacaattatgacatttttagtgtcagtaaaatgtatcatattctaatatgagattatttttctaaaattaatgcactgtagctggagacccaattttagaagaagaaatgaaaactcatatcaaacatcttaatttgtaactcattaatgcaactagcatgacttcatctggaatcaagaaaggcacagtctctcagagtcaatgtgtcagagaaaagataaaactgacaaccctcaagagaattattcttattttaatggactacattaaacaaagaaaatactacaaaatatgtacttttctgtgttacataaagatataagccatgaagtataaaaacaaagtcatcatagatttctatagtcaatcaaaaagacacctgagtctatttgctaatattttatttactttttcagcatcaagtgataaagtaatgtcttaattttcttgaatttatatttttctgctattttcaatcttctatgagagaagaaaaacccaatccaatagtccaccaggaagaaataacctcccaaggagaatataagctgtatatttattccaagtaaatagagagagagagacacacacacacacacaaagagtggcgggggggcagtggaaagagagagagagagagagagagagattcatataccaggattgctccaggcactaaaaatacaaaggcaagcaaggccattttttgttcaatgtcagctgaatgcctttaaaaattgtaatttttcaatgggggttggctaactccagctcctccggttaaatacagctgactacttgttgcatggtccaggtgctaaatatgttttttacacttttaaattgtccagttggaggagaacaacacacacaggggctactggagggtagagggtgagaggtgagagaggataaagaaaaataactaatgggtactaggcttaataccttggtggtggaacaatctgtacaaaaaaaaccatggcacaagtttacctgtgtaacaaacctgcacatgtacccctgaacttaaaataaaagttttttaaaaaaatgatgtagaccaacacatacaatgctataaactaaaataagaagaaaaagaactttcaaagattatatgacatgaaaattatatcaaattcaactttcagcatccataaagatgttttattggaacacagccatgaccacccattccttcatgcattgtctgtcactgcctttgagccacaagagcagaggtgggtagctgacacagactctatgacctcccaaagctcaaaatatcaactgtctggctctttacagaaaattttgctaactactattgggttaagcaaagctttgacagatattcagaatacaaatgaacacaattttagtatcctgaaaatttggagcttcaagataggaagaaatttaaaaagaaggcagaattctgtcagaaggtgaatagaacttaaatactctctcctaagagccaaagaaatgcaagatccaatctaatgatgtaatagcctaggtcaggaatgtaagctttgtgaacagacctggagtttgtgaactgcaagatgcagtagagcaacttttaaaaaaattgttcaagtttattattttaaaagagggcgaagtgtggcaactggaatgaacagaaaaaccactcggaatgtccacagctattcaactcctgctcagccacaatctctagttgaaaagtcagcacatcagctgaagagggtacagtctccttagtagtacacagtaaatagtaagcctggataagcccagagaaaattgaggaggataaaaaagagaaaaaaaaaaacacattatataatatatgtgtttaaaaagaaatctctacatatttggaatattatgtatttgcaatgttttagacattctgtccttattagagatagaagtcaggctcgtgattgaaatttaaaatgatttagaattgtgactttaggcagaaatcttactatgtttgtatgcagtatttacataattaagaaaactcagatttcaatatattaagttatctgatttcccttttaattatctaagttgtttgacagacaacatcataataaattttttaatgtactcttaaacttttataaattcaagatgcaggaagtttcaattctttggtctgagttacaaaaataatttcaatgcaataacttgaattactttgcaaccagtttacttattcccagcgaatagaagccatgccagtaaatcaaattggcataaatagtacaaaatttattcatccaaaaataccaattaagtagttagttgtaatttgtctagaattcaatgtggcactacatattcgagatgaatgataatatccctgcccttcagaaaactaaagaatggtggaagagacagataattaaatcactagggtagaagtatgataatagtataaatggagtgtaccatgaaatcacacatgcagaaaaaaggaaacaaaacccaacatcaagagatcacagaggactttctgggtgaattaaagcttacgtggaatgctgaataaaaatgaagaatcccctaggctataaatagatcacatttagtcaacttacaaaggacaaaacaaaacaatcatgaggaagagaatgatgataattaataacgaataagtgataaggatgattgagatattggcatatgaggatatagcaagatacgagatagaacggaagacagggtctactgtaccaggaacattgtagaatatttaaaggatagattttcttctaaaggtaatgaggaggttttaaagattattttatttctttaaacaagagagcaacacaggtaaggtacccttgactggagaaggactggaggcaaagagatgaactcaaaggctttaataataatggtactggtaagaaataatgaggacagtagaatctgaaaatgagaaattcaaagagcaaggtttattaaatcacttgtggaaataattttgaattaatttgatattaattagaaaataagtataatggacacatttcttgataaatgagctgctcaattcctaaaaggtcagcatgatctcaatgcaatccatggctgcaaccccaaaccacaacctctggccacagttacttgaatcaaaaattgtctttggaaataaaagcagccgtgacatttgttatacagaaaacttttcactttggtggcctggctttaacagatgagcaaatccagtcaaattagagatttaaagattcccactagcaagctgtagactttgcagctggaagattatatacccttgggttgtggggtggacattttcagatttgtgcaagctgatgactaagtctatttgtagaaataggaggatagggcagagcagagagaaaaaaagaaagtgagatgaaaatcatatagtccctgagagactatcagagcagctcagctcccaaaatcttgccagttgccatgaggtcaagtagtcctttcactaccatccttggattttgtgaggcccttcaaagctttacaatttactgtctgttcttgatctagtttacatgggttccattgctcgcaaacaaaaggctctgggtagaaaatgcaaagaaccactaatgatatagataaaatactatacagttagaaatcttttactctacctacaaaagaaattttttagcttctccttgaatattttcagtgaccacatgcataactgtttctgattacaatctatcccatttgcagaatttagatatttgcagccaattctttttattatgattaaatttatcctgattcccattttatttttaaagcaagagctatgactcttatttgtttctttgttttcctcatgccataacctccttctcttaagcagagtgcctaaaaatgtttttaaaattattatttgcatttcccctctcaacatattaactgaagcagtttttcactgatagaataaaatcccctttatctcaaccaagaaggcatcttcatttaacaaatatcatttaatttttttttgttagtaatgtgtttcttatgtatttggtttttggccaaaatgcagctgacagtgcaactttgtatcataatgttggtgaggggcacttaactttctgagtaaagttttagagctcagtttcatatccagtgttaccaatatcttggtagaagaaagggatttaataaaatgaaatgtttaaccatgatggaaagggcattggataaaatgttcaaaatgcatttaggtattgaagtatataatggttacaaatgacatcacaacgttttaatataaaaggatgacatcacaatattttagtataaaaggatattctataaaggtactcacattctccaaagcttacttacgattgtataatttatcaaatttatgcatatatttttaaatagtttgtatattcaatgcctttcttatcctattctttaggcctaggttatttaaaaaagtacaacctagaagatctcaaatttatgccaaattaagtgctggtagattacactgagttacagactttctgcagtgattttccacaacttgaaattttccacctttgaaaattcgtgaattttggggggcagaaactgaatttggatgcaaaaattgctctgaataagaaatagttttatagttatgaatatgtgaacaatgaattagaacttatcaatgttataccaaaactcctctttgattgtaacggtttctaaattcacaaatctatctatctatctatctatctatctatctatctatctatctatatatctatctatctacatatatatatacacatttgtgtatatacaaatgtgtgtatatatatgataatttgtgaattatcaggatatatatatatttcctgaagtcactgtatcatcctagtaaatttgcacaataatatcatatttgtctttaaattatcactcccttgctagtttttttaccaaaataaaaaaacgaatgggtaaagaatatgtgacatatatacacaatagaatacaatttggccataaaaacatgaaatcctgtcatttacagcaacatggatggatatgtaggtcattaggttaagtgaaataagcaaggcacagaaagacaaatattgcatgttctcactcatatgtgtgagctaaaattttcctttcatggaggttgagagtagaatggtagttaccagaggctgggaagggtgtgtgtgtaaaaagagggagataaagagaggttgattaatgggtacaaacatagaggtagatagaaggaataagttctaaaagtccatagcagagtggggtgactattactatagtaaacaaaaatttatcatatatttcaaaatgttaacaactagaagagaggacttaaaacgttcccaccacataaaattgagaaattttcagggtgatggatatcctaaatgccctgattttattattacatgttctatgcatgtaacaaaatatcacaggtactccataaagatgtacaaatattatgtatcaggaaaaaatattttgaaactctattaatgcattttccctcttggaaattatactggtttctttttacttttcattcttttaaaaaagactataagggaccctaagcactaataatttactgttaaactttgagtttcaaatttaactcaaaaattcatagcaaggcactctttcaagagggagaaaaagaacttttctagaaacaacccaagcacacttgatatacatcaagaaccaaagctgagaagacagttcatgaagtcagaagtgagagcagataaagtaattgccacacaagaactctttcagaagtagaggagggaagcaagaagatgagaaaaaagagagtagtgctgatatgcaaatggcttgctccccagtcagtgttgaaattctagggagggagaagatggagtagtttgaaagattcaggttgattggagaaatggataattagggggaggtttcctgcttcccccagtacagtcccggcaagttctaacgtcttcagagaagttcccattttagcaggtgttatggccaccatgcaacaagaagatttcaaatatgtgaacaataaatttgaacttattgttatagcaaagatcttcttggattataatggtatatacatatatatgtctccatataggcaaaattgcctatattgggtgaaatgttgcctagttgagtagacatgagagcagcctcagatggtctggtacactacagcttggagtatgaaatgtgtagttgaaattttaagggcaatggacagcagagcatgcacaagaagttctgagaatgctggtggatttcaagaggactggattcaggaaaagagggttccggagtttgggaactcttgattattggcaaaggccagatctatagtcaccagcactggatttcagaacaacacttgaaagacaagatggtacccaccatatctcagtggacactaggtcatgatgctcaatatcctgaaaggcagaatctcactgtagcaggtgccatgagatcaggttgagacacctaaaatgaagaacatctaactcaataacacaaaaatacatacatttctctgtccttctagatactaccttggcaagggaggaaggaaaaaagttcctaaaacagaaccaccccacagcaaacacacacatacacacacacacacaaaactagtgagagtgtttcaaactaaaagagactgagatctcttttatgacacgtgttactttatatgaggaaatgaaagttcaggagcaagaagatattcatcatagaaaacaggaaaatttacaggaatgtattttcttttatttttagaaattgcatgaaaatttcacttgttataactataacttggcaaactccttcattcatgctgcctttgtggtaactgtatatatctaccttttctaaataaaaccagaatataacacaaggtaacatctaggaagaaagcattagcaaaccgtgctattagccacttcattaaatcaggcaggtcataaaaaacaagcaaagccacattttcaaatttgttcctcagattcattttcacacatcatcaaatctaagtcttcagtgaatatatgagtgttataaatatagtcagcatctcagcctgcaaagaatacactatgagaattaattaccaaagcacttaaaattcatcaaaatcacaacaaagctgacaactattatttacttccatatcagatcagttgaagattaatgtgaaacaagataaatgtatcatctgttctgaactacctacacagtaatcatctctggctcagtataatttccaaatttcactctaacatactcataaatacttaatattacatatagcctgtattttatctgaaacttttatggtgctttaccataaaaataatcgctttcaattatattttccaagccattcaaatgccacactaagaaatatcaacaaccttattttagataccaacgaaagacaagtattgtttccccaaatatctttattacagaaaattaaaaaaagaaaacttttccttaaagttccaaaattttaaattttatattgaaaaaaatcaatttattcaatttcccaaagggaaaccaaaaaaagtgaacagcaaattgactattgaagattaaccaattagtaataaatatatttattgagtttattgcagattattcaattaatatatacatgctatatatatatagcatgtaatatacatatatacacaaatatatatacataaacatatatatatatatatatatatagttttgaagaaaaatataaaataacttctccattagaaaattatctctgagatgtggtaaggagaagaggaaatgaagaattttttttttttaggttaacatgacatagctagaaaaacacgctatatttcaaatatagcagttaagactgatgggaaagtaaacattttttaaaattcatgataagttccccaccggttattgacaggtttatggttttacgttagtaaatattgatttattaagtatatactctttatagaatacaatacagccctaaagtctgagtggaaagcagaaggagaattacaaaagaaatgaaaaataagcatcttccaatgaagcacttaattatgtatgtatgttgtaggcaaaatgaaaaatttaatatggaacacttgtagagaaaccaggcaacagaagataattctttgatgtgtttaaagtttaaaaaaattctgctgggacaattatgtagtatatgaatttcagtatttagacatttgacttttcccattatctcacaaatcctccccactggcaatggagacaccatctccttatttcaacacttataagtaaaaaagagacataaataaaagaggagaaagagttaagggaggaagtgaacaaaaagaaagtatggccctaattataatcaaaggcatccaaaaaatacagaactgaaaaatcaattattccttactgtgtgcctttgccatgcaatgccaaataaaagaactgagtgtacttggattccctcttgcccttcacaccaatgttttgtggaccacttactcatctaacctaatacctgagatgcctcccttataactcttggtaaacttagatgttctctacagaccacgtattctaatgtcaacatgcctcaattagagtgcatatcaagacgtattttaagaatcccttcttcctattagactgttaatgagttcttcgttttaccaatttttccagggcctgacaccatgcctggcctgccccatgtctgacctctgcaaatgttcaatctgaacaaaagatgagctctaagggagaagagaactggctggctaaaaggaatctcaagatgtaacattttcttactgaatattccctagatcagtgccttccccgcaatcttttggggttaaatatttgattttgttcaggacactaacagtggatcaatctctcaaacgtagactcacattatccatgtttgcaatctgataataagcaaaagtcccaagaaatgaatagcaaacctcacagtatagtaggtgagagcacaattcttggattgaattgaatcaaatgttacccccactaggctgtaatgttagaaagttattatatcccaatgaacttgtttcctcccttgcaaaataagcataaaaatagtcacctcaatagttggttgtgaagattaaaaatgataaggtatggtgaatacatagcataattactgcatattgataataaagaacaaatgttgatattatcatgacaatattaaagaaaagaagttgtagatcttgatgatcaatccattcctccattacatgcatgttcatgggtgtcagacagtattcttaatacatggatatattattatataaaacataatggagtttaggttctagtgcagatagaaataaacaataaaaatacacaataaatatgttttatgtaacagagagaagatatatgctttggaaaatataatagaggatgttcgggaagattggaaatgctgaggatgagggaaggggtattgccattttaagttgggaagtcccagtaggtatcatagagaagatgctatttcaacaaagacttgaaagaagtgaacatgtggatatcaggagtaaaagtattttattatagaaaacagcaaatacaagggccctcaggtgtaatgtactgtctgttttgtggaacaggatgggggctggtgcagacaacatggagtgaactagggaaaacatagtatgaggtgaagtcagagcatgagtcgtgtccatgggtcattctaagaatgttggcttccatctggagtaagacaggtagtctggagggttctgagggcaataataacaaaaactgagttttagcatcactttggctgctgtgttgagaacagaccatagagcgaccagggtagaagtatggtttaggatatgtagttagaggactattgtaataatccagatgaaagatgatgctcagaccagggtggcagcaatagaggtggcgaaatgtggtcagatttctgtatgggttgtattgtgtgaaagagagaactcaaggatgatttcaagattttatactaatccactggaattgaattgttatcagttaagatggggaagactctgcggggagcagttgagagatgaagtccaagagttctgctttaagatacgtcaactgagatgcctattagaaatagaaatggagaggttgggtagacatttgcatatatgtgtctgaaggtcaggggagaaatctgggcaggaaatatacatttgagagccttggcctacaaaatgatatttaaagtcacgaggttgggtgacatttgatgagatcaccaaataaccaaggtctgcatttgcagtattccagtcttaggatgtctggagaggaaaagaagctagcaatgaaatttgagaagaaacaagcgatgtaggagtaaaacttgatgtggttttcccacaattagcatcaatagcatcataacagaccttgctagaaatgcaaacctcttaccccacccatgccataacgaatcagtggggcccagcaatttgtgttttagtaacttccaggtgattcttatgcatgctaaagtttaagaaccactgctgtagaggggcagtagaatttggggtaaaaattatgaattttaattaatctccttaaatgttaatacagtgtcactgaacctctttgaggaataactcaactagatacagaacgaagcagtccctcattgagctcaaactcaagcactccacctttagatgctaccacacttagattaatgttttcacacactctatatttcttattttctcattttccattgctgttaggtgtgattgcttagaataagttttattccctcaatttgatttcactaagttcaatttctttccattaaatctgattaaagaaactcaaatttaactaaggttttaaacatccaggcattattagcattccagaagaggggtttgtttatctgcaagaattcccacaatgtggaaaaacagagagagagaggagacagagagagagagaaagagaaagagagagaccaatagatatttgtgtttatagccaatttcaggcagattctgtacttctcaccaactcctgttctcttgccctatcaaagcaaacaaaccaaaataaaatgacagttaacaaggtaataaaaacaccaaaccagggaataaagaagtaaaccttttaaagtcttctttaatatttaaatagaaatatttatcataagacttagcaattaagaatggaaagagctatgttttatatcaattcaacaactgatttggggaaagtgatttaacctctcagagtttctgcatgtttaacgatacaaatgtgtacagaaagtaaatattccctgtaaacttaccacaaaggctgggcttggtctcttatatgggaaaatgctttgtcagctgaagaactaagcagagattaaattgatgttaaaataaatttttaaaatgtatctttcattaagggaagaaactttaggacagggagaatttatcaattttaaattttaaataaatgtagctctttaggagtttaaaaaatatttcaagggaagattgcatatatatagtcttgatatacattgttggcattgttttattgatacaaatggagtattcaaaacaaaaattcatatacttaaataattaagtatctatactcaaatattattgcagtttagaattctaagctattttggcctatttaaatgaaaataacatagagaagagtagaaaataaaatgacataccctatatctatcattaagatttaagaagtattttcctactgctatattatatttagatctctctttaggaagacaaatatgtcacaaaaacaattaaagttggtgcctccgcattccatttctctttatctctttccccaggggtgcctgctatcctgaaactggaatctattattcccatgcaaattcttgcacattatatacataggtagatactcataaacaacatatattatcattatgtatttaaacatttgcataaacaacttactttttaaacataacattaagttttaaaatttatcagtgttgatacatgttgttaaatagtcttctattataagaataaaactatttaggctgctacacagaatcagttaggctgtttccacatttttccccatattataaacagttcattggcaggcattttctttttttaatgagtgctattcaaatgaattcagctgtgggaaattgtttgtggctcattcacatctgacaattctgttcatgggctcctcctcaacagctgtccctactaatgcaagataattttatgtaaaattaatgtttccataagaaggcctcatgagaggagttgtcttctgtggtaggaagtcaagaaccaaaggaaaactataaactcaaagaagaaatatgcaacaaagtaaatcagttttggtgatttcccaggtgattttacaggttctatgccaatttggaaaatgcgttctcttcttttgttgaaaaataaaaaaatacttgtgaaaaaattgttactgctcaacaaatagttctctttcattatattaattagacaaattatgtctttaaagcaataaaaaaaaccctgctaatagttccttgaatatttggcatttttgtgatcagactgctggactaaaaagacttttatttcttgagttgtcttcctcaggagttgacttgttccaggctacaagtgaacaattctgaaaccactatacatgtatgatggaattgggtaattaagtaaatggtgactgatgctgggagccaggcttctcatattggagttggaagttacagacaagcaagctttgaagactagaatgattggtatattactggattagggttagaaacatcaggatgaactcatgttcagtttaatatagatgtagatggataccgcagtgagctgattggtgacttccaaaaaaaaaaaaatgtatctgttctaatccctggaacttacgaacattaccttatatggcaaaatatgtgatttaactaagaattttgagaagagtttattctggtgtacttgggtgggccttacatgcactcacatgtatcctttaagacagggcaagagagagctttgggacagatgagcaggcaatgagaccatgcaagctgagactggggtgagtgcagataccatggaatgcctaaagccacaggaggctgaaagaggcaaggactatattctcctctaggagccttgggaaaggagcatggctctgccagcacctcactttaggacttctggcttccagtctgtgacagaataaatttatatcgttttaagccactgattttgtggtaatttgttaccacagggcagacacaggaaacaaataaaatagatacgtagaagtttttataaatatgtgcatatacaagggttagaatgcacatatgtttactttgctccatctgctgagtgatcctagaagtaatgggaccccagtaacaaagataatgctgactaatataaccttaaagtttccctcagctggactaaattttaacagactttttcctgactctaggctcctgacctcttttctaaagcttttaccttagaaaatttgtgaatataaatatttctatgttcctttgagatataaatcttttaaacagcctctagccagctttatagccaggaatgtctttttcaggaatctggaagccattcttttgcaatgtaatcataaaatagtttcctcatctcccaggctctgggagaatgagcccccaacttcctagggcatgatggttcaagctataaaactaccttcagtcatgaagatcagagaaagtttacttttccattggataaggaaaattagaaaacaaaagtggcctaggattcccctatcccagctcttaaaatttcttccgccatttgttttaaggagaattaagctcagattaacttgtggcctctctccatgtctgcagttgccttgaatgaatcttccttttactgcttttactgtttaaatttgccaggcacagttttggctttgacaatacctagagcctagctgttggtttctaacaccattctccaataaaagaagttaaagatccacggagaaatagctgattctaggactgggttgggaaatatacaagacaagcctggaacattttgtagtgccagaagtgctaaaaacaacagcaacatagcaataaataaaccacacaccaacacacacataaacacacacaaaaaatgatggggtctgtcaaaaggacagcagtgaatagagctcctaatgaccaaagtgtgcaaattttgagcaacaaaaaaggcagaaataaagtagtattgtattacaacttaaaggataaaacaaatatccatgaatccataatcacataaataaatgatgatataagtaaataaatgtgaagaatatagaaatcttacaaaggtttgcagaattcaaaataatttatatggatactcttccttaagtaggtggagcataactccctactctttaaaggtggactgtcaatagtgactttctttcaaagacaaatggaagtggaatgagttcacagagtatggacgtgggcaggaaaaaaataactttatagtgaagaaacccgacaaacaattcctcagccaggtgatcaagattaaaatcaacagtgatatgtaatattgacagtatgtactcttcatatgatgtgatgttaatggcactttacctctgtggtcttcttccccaaacccataactctaatctgatcataagaaaaatatcagacaaatacaagttcagggatattcttcccaacacgtgactagtatacttcaaaactgtcaaggtcatcaaaaacaagcaaagtctgagaaacagccaagataaatattatgtggtatcctggaagagatctttgaacacaaaaaggaccttaggaaagagccaaagagatacgaataaagcttagactttagttaataaaaatatatcaacattgcttcattagttctgaccaatgtaccataccaatgtaagatgttaataacaggggagacttggtgagggtatatgctttctgtgctatcttcacaatttttctgtaaccctaaaagtattcttataaaagcttattaaaaaatagatctttatttttgagttgattttctcagcagataaagaaataaggtccaggtttcctacaagaatgttcattatcttccccagaactgatggttataatccccaagatgagaatgtgctcaggcagcatggtcttaatggagtgatagtgtacctcatgcccagtctccagagcagtttttatgcaaatgactattgccattaggatgaagaggagctgttctagctaatggggcagcccaacatacttccggcatagcttttgaatgtctctttgaacattcactttgtttataattatctgactgtacctaatttgattctacatgaaaatttatataattatgtaattattccattttaatgtaagactgaaacagactgttaccactattcttgagattccacagagaactgcatgcttttgctattaaaagaccactgttgaagtatttgaatattatctcttaggaactgatgaaatatagaggtttcaagcatttccatcagcacacaattattcacaacaaccttctagatgcttattttctatcttttcctatacaagctgcttccaaatcaccgtcattactactgaagaattcaaagtcctgagctcaaaagcaatcagaacccataaggtagcataattaatagtacaaaatttcagttaaatgcttaaatcatagcaaactacaaataatataacaccaaatagaatattattgtctcaatgaggtaatgactcatcaactaaaaccacctaagatagaactttttggtatctgctttctattggtacaacactttcattcttaatgtttcttatggcttcacaggttttagaaataaaacaatacattttcagccttccacagtaatcaacactttcaaaaactgagatacacatatgcatgctacactaacttacaatatacaagtatttggttatatattaactctcaaagaacacaactgtttactattccctttccacaattgttaacaggatgcactttctttaaatataaagtgaagaaaaatcagaaattttgcaaccaatattttccttcagttttctactttatcatcttctgataccaccataccctgaggcagttgttgttctcgggtcagagtttgacctgggcctcctctaagcagtaggatgattattccatgtgctagagtacaatggaggataagatggggggcgggtgccacatgtctaaaaagagtgctgctgatatactgctgccaaacaaatacccaatattcctccagttcccacaccagtccagaatcctggtccagaattttcatatgcttgtcctgcaaaaggacagtcaaaaatagaagttgcaccatggctagaattctgcagtcctgtgaatgcagaataaagactggcatcaggggtcctgctcagttggtgaatttctgacaacggtgggaaatgcacaatactcagaatatggtggcatagaatattgaccattgcttaggaacagtctataaactacaaggtagaagcaccacagtggtaatcaatccactgatgccacaggaatctgcagagtaccactaataaaaattatctgagaggccaggcgccatggctcatgcctgtaatcccagaactttgggaggccgaggcaggcggatcaccttaggtcagaagttcgagaccagcatggccaacatggtgaaacctgtctctaccaaaaatacaaaaattagccagaggtggtggcatgtgcctgtaatcccagctactcgggaggtcgaggcaggagaatcacttgaacctgggaggcagaggttgcagtgattcaagatcacgccactgcactccagcctgggcaacagagtgagactgtgtctcaaaaaaaaaaaaaaaaaaaaaaaattcatccgagaaagaggtaaagctgtggtgttttccagattctgaatttcttcaggccaagttccaagaccatacaacctaagttatattccaagccacaggaacctctttgtacacacaggtgttcaggggattcatagcatttacagcttaccactgtttttttctaaatttgtgtgcaatatctaaatcactctcacattcccatggggtctttccagcccagtgtagagcttgcaattactagaggcaaatgcaggctgtggtagtgcatgcttctgtgcagttacgccaggagctccagtaaaaggaaagtcacttctacactgttttaacatacatgaatttccccgccgtagaattaccatgtacatctaggataaatttattttatttaaaaacatttcggaaagtcccactaccaatcgcccaatttgtcaatataatataccccatctatcacacccacagagatcttaggtataagtaaaagcatctaatgaattcactatgcttggtcatgcctgaacatttacatattaaaatatgtgctatttattatgcattgactttctcttacctctttttttttttaacatttcagagaaactgggctttttaaaaatatttcttctttagatagatcatgttttttatgtgtttagatttaggaagtaaaagagcattggcttagaaagcaatggatttatggtaagtcgcagcagttgggcccagaaagtgtgaggaccactggtccagagaacttctgattctctacctgtcttcttctctaatagggaaagagttagcaggacgtcacttctcagttcctaatcatgccctaagcctggcagtgagaagcgtggcagatgctaggggtgggcgtactggaagggaaaagaaaataatattttccagtgcctagattttggtgttggcaggaaaattatttgcccgtgacaaactgcatttatcttttatggaaactgtgctcaatttatgaactacactcactttaaattaactagaaaccaaagttatattgtgtaaatttcagttgaattccaattttactaaccaaaactcctgttggttaattatacattttacataatattgaattcagataacaaaagtcgagcctcaatctctcaatctaaaacaaaattcagcacacttcactgtagggtaacaactgttaacttattgactaacttttttttctttccttttttttttctttttgagacagagttttgctcttgttgcccaggctggagtgcaatggcatgatctccactcaccgcaacctctgcctccctggttcaagcgattctcctgcctcaggttcctgagtagctgggattacaggcatgcgccactacacctgcctaattttgtatttttcgtggagacggggtttctccatgttggccaggctggtctcgaacttactgactaagttttaaatgaatcagtgctacatttaatttgaagaagtaacaaagagttagagaaaaaacaaagataactggggaattgggtgcaagtccaccataatctgttgacactctataaaaattccatgtgagtaatattttaaccagaaaaataggaataatgactgttctctagagcaaccataaccagtacctagaaaatatgtaataaacaaggaaatggactagaacactaatgtggttttctggcaaagaactatccttacttaaaaataatgagaagaatattcaaatacttactttcctttaaataatgaaaactttaattcatgactcccatagctgttgttaggatttatgagtgaagtcactaaactaacattcattgagcacatgctaggtactatagcaagtgctttgtatattgcatttcaatcagctttccaaataatggtatgaggttattgctactatatatcgtaatttccaagccaaaacttagaaaagatcagtaatttttccaaagtctatataatcaagaaacaccagagtaggagatagatcccaagattcgttgactccaaaggctatttttctaaactctaagctctatttactgcctatatagtaagaggggattagcagcaacattggaatttacacagggaaatacacggggaatgttcgatcatctaaggccttccaataatttttcttttttccaaaagaaagcaagagcaagtttattttctgttttaattaatatttcaaaaaaagccatcaagaagtctgcttgtttgaatttctaagttttcacatcaagattctgatttttaggtttgtccaaagctggagaataataaagtttgatatattcaaaacaatgttttcctttatatgtttttctagagatgggagtctcaatatgttacctagactgcacttaaactcctgtgctcaagcaatcctctcacctaagtctctcaagtaggtggaactatagacatgcaccatcccacctggcttaaattgggatatattaatgttagtcaatggttcatccataaatgaattttcaaaagcctcatttataatatttaaagcttgtatgtaaaaatgcacgtagccttcagaatttgacatatttcccaaattcaatgtagtgccagatgataaaaaaatccaaaagaatgcaacacaataagtatgttgaataaatgttaagcaaattttattttgcatttaaaaacatattctttttgcccatttggaatagacatcatgattttaaacaaagaaactgcaggtacttactatggaactatacaactaaatatgcaaagacaatatttgtgttatttcaaagctttcattggtaagctttttattagcaaaaatataaggaagcttagtttcctgcaagagaaataaatagtaaaaattaatgtctctgagccatagcttgcctccacacaagtagtgaatcatttctcccatctgtcccaacctgaatatatcccttagagatatctgcctttctgggaagagcgttggcatgtatatttattattactttcatttatatacagttctagctttgctgctatcttcctagagccttcagttcttctgtgatgttgagtaagagttatatgttttactggaaagatatcagtcactattattcataattagaaataaaatctttgaattgattagaagataattaatgtatattctaagaaaaaaatctacttttaagatacataatgatacacattagagacaccacaagaatggatagaacttttggtttctctaaaaatatgacctagatgtcaactagagtcttcctcattttgatagttaaataatactaactgctgtccccatatcatggcctatgggaagtctaatgcattcctctttgatgcttttaagtatacaggagttttcattcttgcaacaacctggtcgctccaatgttcttatctcactaaatccttgaatatgtcccattccattagacactctcaaaacatcactcacataaggcttttgtgtgcttatgaggtaagaaacaataatcatagatcaaatagtaatatgcataaacaatagcaatcagaatataaggcattcttattttaagattttcttttttagccatgttttctactcactggcaggtcattttgctgtctggctggtcattttcctgctggggtctctattctctctccacatccatatatcccaattaacatattatatgaagctatttttttaatctctatttcccctcgcttgactaaaccatccccaaataatttttatcttagcaaaaacaaaaacaaaaaactaagatttttaaggtatattccaaggcaaagatagctttctttctgaaaggaccctttaaatatcctattacaaaaacagtttagtctaaatattgtctttaatctcaaataaattgacgaattacttagcaggaggcactagagacttagagtaaatgacaaaaatctctgccctttcgaaactctgtctacctgggaaaatgtacaaatgaagaaggttacagacaatgcactaagtgttataatagagttgtatgggtttaaggagcagggaaaatctggggattagaggtctaggggctcacagattcacatagaaggaaacatctgagctaagactttcagaatgaataagaatttgctaggcacttgggaaattaaggcattccagatccagggaaaacatttgtcaaggcataacgataatttatttgaaaaaatagtaattggatatctttgacagggtatgtatagaagcgatgtgatccaattagacagaaggtaggggatttaagtgatatattttgaaggtctaagtaagacaggctgtggaagtaaacagtagaggatctgaaacagatttcctgttgggagtttggtttcaaggaactcaggtttctggctgaggcatctctgcagaacagcattaaaatatccaatggtgatttttagtttgacatttgatttatgctgatattgatgtgcataggggatgttgaggttagttctttagtagaactaatcaaaataaactcaaggtgccattaaaacagcaaaggcaaatatgtcaataaagatacaaggggaaatcatttaagggggaagaccagtggactaacgactgaactctggggggaaaatctatatttaatggctaaaaagaggaagaatctgagatgggaagaggtctcagaaggaaattggaagaaccaggtgatagcgctttcttagaatcctaatgaaagaattcaagaaggagggagttatcaatggtgataaatggtgcattatgatgcattgagatcaaataagagagtaaaaaatagttattgaatttggcaagtagaagaacagaaaagatagagaaagcaactttattggcatgactaggataaacacattacagtgagtggaaaatgatcaggctagaaatgtacgctcagaatttggtgttgctgccaacacatcaaggtcagacagcaggacttacttagcatgtagcagatgttcaataaagtttatggtataaatgaatgaaaagatgaatggcaaatgaaattctggggtgagccatatccaaaatgaaacatggactatatgttttactatcaggtgctgcattattaaatttagttaatttcattattttaccatactatcattttgaaaggaagctattctgtcattagaaagtacagtccaccttccatgtccaaacagataaaaaatattcaggaaaaaacaattaaaaataacaataaaacaatttaaaatacaaataaaaacaaagtgactatttacaaagcactcacattgcatgatttacatagtattcgcattgtattagatattataagcaatctagagatgatctaaagtatagtgaaggataagcatccatggattttggtttctgaggggtgaaataaaccccccatggatagcaaaggacaacagtaatctattcttgaaatcttatgtttttatagttacttatttgtgtactatcatatttacttctgagtgtgtgaaactgttattttagaagtgatttttgtattgtatatataaagtcttttcaaataagcatatttatgtatccttttacgacctccttaattacaatctctgttttattcactcattctcaaaaagaacaaggaaacaaggtgatactgtggaatcttattttttattagataactacaactggattaattactttaatttctctcttattcaagatgcttttaaattaaatgcctatactgaggcctagatgaatattctgaacacaaaaattctaagaaattatttcagtataaccaatttaaagaacttaattatttaacttacacaattttaatagataaaattaataattaatttaaaaacaatgtttatataatttcaataatatttatcactattatagtaaccaaaataatactatataataaccaaaattattgaactttagaaataaatggcaaaactactttataaggttaatcagaacctcagaaattatggattgaagaatcaacactattaaatatgtaagcatagaactctatgcaggaggagaaagtaagaaaaccttctggttaagtaaattatttcatattacattgtgtccccttctaagtgtaaactgcactgtgtaatatacacattttttttttcttgaacagacttagtcataacagttaattacagagacaggtatttactttgtaaatatagatgcaactaaattgaaagtattattctggaaccaatgtataggtttctgacttgccaaacatgttacaattgaaatgtcaagaaacagtaccttctagtatctaagttatcaatcatgatgactatatcaataaaaacttattatatgtttgaacaatataatgaaaaatatgaatcttttgttatttaatgtttggtggtttaaatatcaaaaattcatgtgtgtagctttccaaaatgataataattcaaataaacaactcagttcaattaatactctaaattcaatttttgactaaattttacataagtgaaaaagtagtttcctatttagaagatatgatcccattcacgctaaacagtaaagtagctttagtcatttttgatgatgtaggttacccagagaaactatattacagatctatgccacctacactcagtccatcgacaacgaaacaagtagttgtaatgtagcctattaaaaatcaaatgagtaattcacattttttccatataataaatagtaactgagtcctctgccattcactttgctcatcactgaggacacagaaatcaaagaccgatttttttttccccctaatgaaagagccacagttcatgtacagagtgtggtatgacaggaacacatggatacatgaaattccagagaagaagcattaatctcacgggctgagaggccagagaaggtatcttaggcgagctgtaatctgagctaaggtttgaagaatgaataggatttagccagataaataagggaaataaattgaagcattctaagcaaaggaaataaaaataggaaaaaaaaccaagaagcattagaatgtaactaactcaggaatacattaataattaaaactgtgcctgtaatattaatggtggtaaattgtatttttcaaagatggataccagaaaatatcctatctttgcatactcttttgaacgttagcttgtcctactcccatcaagatgaagactggacttcatttctttgaatcttagcaggccctgtgagcactttaacccatagcatgtggcagaagttggtagcataaaagacacaagcatagcacttcaattacctaacaacttctaccttctgcttcttgtagccctaatcctggacctcatgtaagaagttcaggaaccacaagactctgcggaagagaggagccatagaggagcactgagctgctagacatgtgagtgaagaaaccatccttgcttgacaccagcccatcaaagactttgcatgatgctagtcccatctgctttccaattggaactgcattgagagactttgggtgagaattatccaatcaactccctggtcagaaaaaatagtgataaggtggtgttttaagcctccatgttttggagtttttgtcaataacagtaaataactgagatataaagtgtctgttttgatggtgatgatggagtaggtggtaagagctggataagtgacttggaaccagattaagaatggttttcatggcatttaagattttggttttagttttaagggcaatgctatggcaaaaagaaattaattgatttaatacaacttttttttgctagaaatggggatttgatccaatttatactaaatatcacaatataaattaaaagaggtgagcactagaatgaggagactcagttgaagggtgcttcagtaattgaagtaaaaatgataagtctgaactaaaatggcaacagtaggaagaaggggatacaagtgatgtcaagatttacctaggagataaaatttgtaggacttgatcagttgtataggagagatataattttaggtacttaattagtaaaaagtgatggcaactcaaattttcctaagccaaagtgggatatgttttcaggataatggtgcttctcttggaactcaaagactgggatgtgtctgggtctcagggacaactggaactgggaaccgaaatgtcactttccactttttaactctgctcctacctaaatctttattttctttctctgtaccatggcttcttccaattttcttattataatggaggaacacatggcctccaaattgaccaagatttacatctaatagttttaagatccaacaaaatctactatctctttctcagatccaggaacaaaatgttcaagaaatcttctgatcagatatttgaaaagaattgattttaatttgctcatgtcctcaaagcaacaaggggagtttgaggtgtagtgaatagtttcttagaagaacaacgattgtattccaattaagggaacataattcttgatcttagatcaggtggacatttatagttctgggatttgaaatataaatgttttctgaactaaaaacgtatacagttatttcagcacaagaactgaaggctgttcagaaatgtataccaaagtttttcttgttcagtaccatgtgagatcatttcaaactctcagtaacagagatgagtcaaccttctaataagtattggtcttctctttctctaaagatagacatttttgggggaataggatctcagagtacagtttgtgatcaaatctcaaaaaagtttattgcatttacaacagcatttttcaaagagaacacctctaaatacgacacacagttttgtggtcacacgaatcctcaaagtgctatattttatgtctgccttcaaggtattcactatatagatgagaagattaaaagctctaagaaatctgtaaacacacacatgcttctaaaactagtattttctaatgtatttgacaacctttttaatagtctttctaatatcccatattatatgttgtaggaaattcatataaagtaatattgatttagatatctaagtccatgatttcaaaatggaaagtttttgtcccaatttaagacatatggtatgtaatatagcataagatataataatgtgtataaaacgtcttcactgatactcttagtcaaatgacattttattgatataactttaattaatgaatgatgttggcacattaatccttttctgtttcccagtagatattatgctttattattctgcaattcttgaaattgataatttataaatcttaacaggcacaattttcaaacagtgacagactttcatgaggagaaaagaaatatttagtcataggtttgtttaaattaatattttcaccatttgggatgacaaagcacaaaaaattacaatttctttttatagaggataagaataaaattagagcacaaatctgtaagtcagtaaattaatagagttgagatttttaaaacatctagtattttaatgcaatgaagagaagaaaacatacagaatcccacaactcatgtctgcagatcaataaaaaggtacagacttgatacatattactgctatgcttcttctgggtacttaaatatggctctaacaaaatataataggccactgtcaaattcagtgttttctgaaccttgtcgcccatcaggataattcagagtttttaaaaatagagacccttggggtttcatcctctaaattaagtgttagttgggatggaactaagaaatgtttatgtttaaaagcatctctggtgattctgacatcactggtctgtaactagccatgatatgtgggaaacactggactgggtgttcctggatcatttggctactatttccaaatactgtaaatactgtgtgttatattatatattccaacttttcaattatctttacttattcatcaaaatgaaatgttattaattagaccaatactttgaagtgatggtagcctaataatattccttgataaatgcacggtggtcattttaccaaaattaatcagatgaatacataaaagtttatggctgtcaattgaataatacttcttatcatgaataatgcaaatgggtttattggggtcctaacattttaaactacatacatgtcaaacttaattaactctgctttcataaccacctacagaatgtcttacccttttttcatgcacattagaagatgcaaaactctgaactgttttccacaaactaacataacatatattgataggacttaataggctatcttacaagtgaaggctaattgctaaaggtgagattaggtaagttgaaaagtggtgctggacatcaaacaagtgggaaaatttgtgcaagtttttaatcaatattttgataggttattatagttcaatatatctaccccctacattaacttccgtggttgtggagtattaaaaaaaaaatcaagcaaaactttatcagtgataatcaaccaatttaagagagaaattccacatatggcctaaaacctgggggctacccattgttgggatccttattactgaaattcaccatcaatctaatagaagctaaaatataagatgtacatgaggactgcacatctttcactttttgcacttatttgcatttttaatcagcaagaatgttgaaaattaatttttatttcaataaaaattcaatattagtttcaataaaagtcaagctgttaatttcttaactgctgaaaatattttttaaaatatttgtagaagtgatctaagttatcttgatgactggcatttttttttccctcaatgagaccatcagcagtaaaaggaggaattaaacaggaagtatttatcaggtctcattcttatatgcttttactgaagtgtatttctctccctgatcaatagctatgcattagagaggacagatatagatcttatatctacacacacacacacacacacacgtatacatatacataaaaatacagatattatacgtatgtataggtataataatataaagagtaatttctaaataaatatttgtctagaaatttgactgaactctgtgggtggagggacaagatcttttattcatcatgatattcccaaatcccagtttctgatagagtaaagactccccaaatccccatatcttaaatggatatttatatcctttctatagaggcatccaatttcaaacttactttggttaaaatccctgcatattttctttcccattgaccaaagtggagaagtatctttaaaactggtcaaccctagcaagctatttaatagctacagtgaatgctttcttactcaaagatctcatcattaaagctatcaattgttccaggaatcagcattatttcagcagttttcaccagctatctttaaaactagtctttgtataggtgaataggtatagaaatttcctttctctataatttaagctaattcataaaaatacactaagctaggtcattactcagagttaaatactttcagattataactgagccttctcaaattaaatggcatttagctcactaaatgtgtaatttacttaaaagtattaatagtcttgagagaattagtgcttatgctaaaatataattacaaactctctggccataaattatttttctaataccatctgagactcagaaaatgtgtgtaaaggcatgccatggcctaatctgggtagcacaattataggggattatctctggaattggtggtcctgtctcaaatctaccattataatagggaaagtaatgtttaaacagtttttgcattattcttgttattcttaagatactccatttatactcaaatcaccctaaaaagataagaatctatcaagtttatgaaataaaactttctgaattcccaggttgtggctcatttctcaaaggggatgtagatgactcattctgcctagtgtataaataatatcattgcataatgcccaattcttctagcaactaagttgaaatatatagagaatcatattcatgcttttccacattttctttgtacttctcaagttgtggagcttggacgtaagccagtacttagaatgaatggaagattgatcagtagttactgtgatctacatttctttatcctagggcaactatattttcatacacattacaatttgatacaagcttgctgacaataattagaaaattcaggcaatcaaaatacaaataaatcaataatagttacactacctggagagaacattcccgtgctttcacatggaatataggatggccctcgcacattggtggtagtggagacagcccatcccagtgtgatcacagagctgtagaacaatgcacatcaaagaagccaggacagcagaaggagttaacagtctctcaaaggatttgtttaggaggacttccaagatatctacagggacttgaaaaatacttgaagaggtggctatgtatttctgatcctgtaatggcaggtgtgggcagagctggtgaaaaagggattactactttctaatttccactctggctggagtggcctggggaagcacacactataatatatgttacgaatatgtgtgtttttccattctatatcacacaatggcattagtgtcatttctagaagagtgtattgtgtattcaaaaggccaaaatatagtcccttctaaactagaacaagtataatacttattctgataagttcttgaattacaatatatggctacttggctagcttaatctattttcttaaattcatttcagagttaatagccctgaaaattaagaaatctttgaaccatttgaaaaagacatactttgtgcaatagctgaaacaattttaaaacacacagagaaaatactacccttcatttatttaaaggagttaagaattgcttcaaggtactctaactgatagaaaatgtgggtaatatcagctaatcatatttcaacaataagagggttaaaggaccttgatgctcattattaaaaaggaatgtgggtgtggtagaaacagcgtgtgcatttgcacgtgtggatgcatgtgcatgcacgtgcatgtgtgtgtgtgcacatataatagttagcaaggatattataggacaataaaacatgacacaatattgtcattccagagttgttgtgtgttatgggtccttcaaaggactcaaattttattttgttgtattctattgggagaaaaataatttttattccaaagctaagttaatgttttcatgttgcataatcaaaatgatgactttgatctaatgagattttataagcacattaaaaattatacccttataattataaacgtaccattagaagactctttttcttagaaactccgttataaacttaagaatgggttcaattgctattgtgtcaaggatttctcaaaaacatcaaaaggaaaacttttttatatttaggtgagatcttgtaaacctctttgaaattataaatgcaagatacttattaagtgattttacatttcatttatttttcttacccaatgctttttacatgatgcttagttgtttttttttttgttgttgtttttttgcaatcttctgtctcatttcccccaacccaaataatttgacacacatcgtttcaaataaattaacatcctatctcagtggactcctttggccaaaatagaaagttcaaatcctaatttgtgggctgacacatgtggcctcctctatccaagatataacacgttattacactttgcactaacagacactgaagagctatgagccttctttcttattcttgtcttttaaactgaggtttgaattgacgtatacctgtgatcctgaataatacaggtactgtagactggaatgtaaaagagacaaaagtaaggtccaaatggtacagatactagaggtagtgtggtaaaggtgtttaaaatattatcaaaagtacgggcatgtctttaaaaaaacagaattgtggtggggggtatgtgtgtgtgtgtctgtgtgtatgtgtgtgtgtgagagagagagagagctagagagagagacagagagaacaggcaaaggagagaaagaacaaatcctaatttagctttagatgtagaactatatgtgaaaggtggaaggtaatcatatgtcattagttttacattcttacatgacctcaccatctgattgtttttatagaaatactagcagagtcatatgtgttttaaaaaagaactaggagaattcattaggatgacttacttctttcataaataaaaactggattgacttatttaataaatgtcctgtaagagcctatgtgtcaggcagaaaaccagactctctctcagagaatacttcttcagatcttaaaattttggtctaaatattttaactgagcttaaatgtgttcaaaaatttgcctttactgcctttcaacatcatgtaaccctagatttataaacacagaaaagcatggaatagaagaaaaaggtcgtatttggaatcgcagagatgtaagtctatttctcagctctagtacaggtgcctctgattctattaagatgggaataagttattaatgaacatacaagcttaaatttataaaatttagagaaataaatctatctgaaaacagctgataatttttaatctattgaaacttctgatcagggaagaatagatatcaacaaatcaccttttatgcaaaagactttctgcccacgttttaaatcaatgagctttgttcctaaatgaaaaactaattgtgtatgtatgtgtgtgtgtatttatatataatcttagctattttatgcaatgatttacataactcactaagtttaaaagtgtaatggcattccaaattttttcctatgattcatttaagataacagcatctatttctattgtagtttacatgagaagaaagaaagacccaggctgtgtatatgatatgagatggcaaagagcaaacttcatgaacagaatatgctgtctcctatgttccacctttcccttatgatattgcagcaaatttaatctcactagtttcagacataacatttcaattagcatagctaataatttagaaaaacaattttggaggctttttaatatgataggcaactatgatagtataagtaagaattagacacagttcatgcttcaaaaacttacaatctctcatgtgaagcaaatagaaatacagtaatgaattaatgaggtaagtgtagagattgtgatgtgccagggtaatacaggagggagtccccccccaaaaaaaacgttaagcaaatctgttggtatgttagaaaaactcctgtccaaagggctcatatagctatcttcctattacttcccctctctctgataaataaattttatattctctggagtgctgtctggggtaattttacaaatcactttttttaaattatagcatagggttcagatggaattagtaacagacgcaagctgccaacttcggtttcttatgtgaaagccacttgttctcaaagggtctccactttctaggcttgcttggtttttgttttctgagtctggttcaaactttaccatatgttcttaaaaaaattaactgcttaagagttgatttatcttgtctgcattgaatagcttattatctttaaccatgcatctacctggagtattcttttgatgaagttttaccaaacaaaattctaactagactttcttttaaccttaacaaatacttcatgttcacatttatgttttgctaatgtcagaaaacaggtatcatcaaagataaaaatcatttaataagttaatattgacagtacttcttttattctaaagttttgttgtctcttaaaaagataggcctttatgtttttcagatctagttttataggtctgtaacagattgtctgttgctaagcattccagaaaaagaaatgtaacttagagggtacaaaaagaaaattataaaatccagtgaaagaaacataaaaattgaatacatctaaaagtagtaagttataagaagaataaattatgctactttaagccaagggttaattgtcttgatgttctttgaatataaaattataattatagccaaaaataattaggccagtacataaaatgaaaataattctgaaaatggtaccctattatatttactgccaagtgtttatttttattctacagatagtcacagagaaaacactattaggggaaaacattgaaaacttatatagttagaactgaagatgataggtaaataagtttcactgaggaatatttcaagaacatgtaggcattttgtaagagagtatgttgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagagtatgttgaatgtacaataactacttacagtgaatatttccaataggataatataacattcattctttcaggatattaggcaaggaaagatattcttgcaagtcattgccaatgtcaatagacaacgaacattgtctaaacagagatgtcatggccctcattttttgtctttctttttgaggagtgaatgtctccatcttgtcctcttttctatatatatgttcttcttgtttttaaattatctttcctaagaaacttcactacatattcctgcccaagtatatcagtttgtctatgtcattgcttctgtcttttatctcctctggtttgtgactccactacttagtctgggtccccctttcttctggcatctccactagatcctgagcctgaacttcaaacattatacactattgacagcacttaaggatttactaacacgtgcttttcatacatgtacaacctctgttctactgtcttagatttctcttttccacaattacccttcttaaagaggtagtccaacttcactgtttccacttgcttttcaagtggaaaagcttgtggaacttgcttgtggaaaaacgtgtttactccatactcattgcaatctggtttcctttttagtgaattaaatccaaaatcctcttcttagttcacatctaatcttttaaatatatgacataatatgtgacataatatgactcaagaacaacccctctactcagcatggaggtctgttgagaaaacagactacagctcaccagaagaaatcaacacacgctgttaaaatcagctaattgaactgctttactctaaatataaatgacttaaatcttagcatctatgatgatacactagtcagtcgttattcattaatttgtgtatttaaaagatataaagccattatcatgcagcaggcatcattacagatgctaagttataaagctgagaatcatatggtcccagcatttgtgaggggaaaaagtacacaaataattgtaataaaatgtgttatgctataatagagatatttgccattgcagtatggtatcatagaagatgagtcacttacaaaaaacctttaatacatatcattgtgtccaagtatataaaaacaataaaaaagtattcaacataaatctttttatttaaaagggaataaaaaattggcttctaaagatttttgtgtgaatgacatcaaacatcacacactcattttgcaaaatagacataagtatgaaaaacaattattttgaatgtattattaattctgataaacattgtacatagaaatcattcatcttcattgaacattcatgacattgatcattcaaatagcacttcaaaagcagagcatttgaaatgagaaaatttacagaactatagatttttcaagctgaaggaaagaaacttagagactatttggtccacactcatcattttacaaagaaggaattgatgctctgggagacacttgcacacaaattctctgaagcataactgaaatagaagcgagcctgctctactgctagtgacctttctaccaaaatgcaaactgaccaaaataggttgtctgtacagtgaactgctattaaggatggagttcttttgttggttttgaggtttccggagttggctgcttaatatgattaggcccaaaaatgctaaggactctacttccaatagtatgtagaacactgatagtccttggtgtgaactgtttagagagttatgcaaaataaatgcatttaacattcctgattcactgcttgtgagaggcaagcagtttactgaccctatacctaatacctttgaccatatgcggagaaccaaggaacataatgaagctggttggttgtttctaagttcagtggacaaagtgatgaaagaaaatgatgtactcagggatgctaactcccggcttcaaaagcagatactgagcctcaaatctgctaagactgccctgagtgagagtcttatcctctctgtagagaaagagttgaaattgtggaaaaacagacacaagctcttatcatacaagtggctgacctgcaaggaaaggtgcatgcacaacctcaccagctgtctactgttaaagtgagggcattgattggaaaagaataggaccctgcaactcggaatggggatgtgtgggaggaccctgataaagctggagatactgagtttataaactctgatgaaccttttttgccagaagaaacagcttacccatccccagtagtggtaacatcccctccccgatccatgctgccatcagcctctccacctttgtctgaggagataaaccctgtgctgcctgaggcaacagtgatgacctcccctgaggcagttgccaggcaagataatgttgattctcctcaggagccacccccaacactcctgtttgcttctagacctataactagactggcctagcctcccagcctacatctttctcccgtgctggatgcttcctgccctcgaatatcagactccaagttcttcagttttgggactcggactggctctccttgttcctcagcctgcagatggcctattgtgggaccttgtgatcatgtgagttaataataaactcctgtctatctatctacctatctatctgtctatcatctacctaattcgttctgtccctctacagaacactaactaatacaactgcatacactcctttctgaaagtatttacaatagcctgagaaaaatattttaatgaggactgtgtgtgttttgccaccacttcattttctccaattataaaattatagaccaactcctaaacacagtgttaaactcccaggaatcctcaaatagatattacttaacataactgagattgtgttgccctaagaaattaataaggaaatcaaatgcctagaaacagctttcatatcttataaaaattacaagctctgccccccaaaaatgtcatgggtaatgccacaaatattttctttatctgtcatctgatcacttcattttaggacaaatctataactatttactttcctttgtaataattacttgccagaggcagaccagaatttgatgtattcaaacctgtcacatatgtatatttacagggaaagcacatcttctctgtgggagagaattaggttttaaagttagttcataaggcaaaagtcaatgtattcaaaaccaccctggatggtccctcagggaagcaccagtctgaagatcaaatactgagtcccactatgctcactccaggcatttttcttcagagttagaatatatcactcctcctaggcaagaggacccagtaaatgacctgccctgccataagggctttgtcttatgaaaagtacatgtacgttttggccgggcacggtggctcatgcctgtaatcccagcactttgggaggctgaggcaggtagagcatgaggtcaagagatcgagaccatcctggccaacatggtaaaaccccatctgtactaagaaaatacaaaaatcagctaggcttggtggtgggtgcctgtagtcccagatactcgggaggttgaggcagaagaatcacttgaagccgggaggcggaggttgcagtgggccaagattgtgccactacactccagcctagcagcctggtgacacagtgagactccaactcaaaaaaaaaaaaaaaaaaaaaagaaaagaaaagaaaaaaagaaaagtacatgtactttttaatgtatgaaaagtgtctttatcaactaggattacattcagcattagagagtgctcacttcaagagaaggacacatttttcaagtttccgtattcacattctcttagggggatatacactcattgcaatggattcctgtaagatttcagtggttatttgtgtcccatatttttgttgttgtagaacatgtgtgactgtatttatacaagatacatgtgcaactgatgccattccacttactacatacactttctcatatatctatgtttatacactgacatagatgtatatcagtactcaactgtacatacgtgtgtactgtaagaaatgttttatggtataagtttgtttcaggaaacaactgcatgttgtaagaataaaattataatagtaatgcagtttataaaatatgtaattgttgtataataatttgtctgatctttttccctccctgggagaaactttctttttcttgagactgagtggcgctctgtcgcccaggctagagtgcagtggcgcaatctcggctcactgcaagctctgcctcccgggattcacgccattttcctgcctcggcctcccgagtagctgggaccacaggcacccaccaccatgcctggctaatttcttttgtatttttagtagagatggggtttcaccgtgttagccaggatggtctcgatctcctgacctcgtgatccacctgcctcggcttcccaaagtgctgggattacaggcgtgatccactgcgcccggccaggagagactttctagacccttataattgataggagtgtttttattattaatacctgattttgtgctaataaaatgacttatgctgggcctttagatagttttagaataagagatggtcatgtcaaaaatatgaagcatgtgattagtggatttggggctttgatccatgtaatatttgactaaactcctgactccagtgagaggaggggtctacagattgagtccaatcacttggccaatgattcacctaatcatacctgcatgataaaactccagtgaaaactttggacacctgaagtgaacttcctggttgatgatatgcactgatgtgctgggagtgtgatacatcctgataacaaagaagcttcaaatttgggaccctcccattccagggcttatgtgtctcttcatttggctggtcctgatttgtgtcctttctactgaaactgtaattgaaaatatagcactttcctgaattctatgagttgttctagtgaattattgaacctcggtggaaaatgtaaaccttcacatttatagacacttgatcagaaatgtaggtggcctggcaacctcagagctttcaactggtgtttgaagtgagcatagtcttgtggatgcctgtgtccttaacctgtaaagtctgcactaattccaggtagtgatagaattgcattgcagtaatcatgttcctaatctgactaacactaggtttaaatgaacagattaagttgtttgtttaatatgcaattcatgtaaacttcctcaagaagctgtacccactagggggtggataaaacattaatttaatccaatctgataatttaaacagtttcttgagataaaggacttccatatctcctgctctggctactctctgagatgacagtgcagggtacaggtcatatataaactcatgaaaaaggacaagagtcagaggcctagaatgtgctatcttttgcctcttctgtcaccaaggcactgtcccttgtttgtctgatggtgggtctcctttcttgtattcaaacatttgtctggggttaatataacttgggatctctgttgaagcctggtcgccattgccagttagactttccttagctaagcccctagctctatagagcttcctgaatgggtggccggccctccacctttactgctgggttaagttgctttttcccatggctggcccaattgcaggccttcaggcactcaaatctgcagctttcagcgtgtcctctcagggagatttgatctgagaactcataagtctttccatcctacaggggatacaagggagtgtcttgtctcatatacagaacaagaatgcatgatgagaaaccatccctccaccttgatatgcctttctttttatcaaatacgtcttacatcagcttcatgcctggccttccttttcttccattccccatcttgatggagaggaatagactctctaccctattctctacagcgttactcagtgtcagaggtcaaaaactacatggtataatggggaaattaaaacaattcagattaatttcttcaaaatggtatcttttgttaaataaagataaatattcatatttatatatttaaagaattaaaacatgtatgtggccaaaatagaaaatcactgttttgataaaaatatattagatattgttctacttttcttcataatggtattcaaataggacagctaaagacaaaacagtatttaaactatttaatttagttatcaacatgcattcattttgaatcatgatttttaaataatattgctgaaaatttaaagtagtgtggttggtgagaatcatagcttctttctatgtgttcatatttcattgaataatagagttgctttttttatctttaacaaataaaaacatgatcaatacctagcattagatttcttacaatttgaagaaactttataccatattggttctgctgtacaaatgagagataaaattgctattttaagatgagaattgtacgtaacttttatcttccctaacaaaaagtaatgtgcatttactccacaacgatttgaaagtgtgaataaaaagtgaaataatctaaactccgactactccaacaaaaaagcctttagcttccaatacgtaaaatcactgaatcctatggttcagagaaacaaaactagttgctaatatctttccaggtatacttgcagatttttcaaaatgcattcattgaaaaacatttataacaataatattacactgtagaggaatattgtgtcctatattttaaatttaacaccaaataataaacaaaattagaatattaaacaagtttggaacattgtcattgtggaattaggaaagaactatataataataccaatagcttctacttactggcacttaatcaatacaaggatactgcaaagagctttatttatatatgctaaaattttatttaatacacaaaatataggaagtaagtgctattattgttccttttactgatttttttatagataggttagaaatgattatgtcaaccatccaaggttacaaagctggtaataggcagtgagggcatttgaactctaaactatccacaatttaaaccccaagtttgataactgagagaatgagccatacctataagctctttctccctgtttccaaatctagacacaggctagccagttatcctgaattatttcaaaacccagcaaagcaagtgttcactcttttcccttccccttattttccaacctatgctcattactacttcctatttctcaaatatatgatggctaaccatatggttaacatcatatatattatcttgggaatcaaagatgatgtattgaaagataagttttcactaaacccagtgataatagaacaagagatgctgttttttgacttgacaattacatttaatattgatttgtatgttttcctcaaatgttgataatatttttttcaaaattcattggccccatttattcctttgaaaaatccacactaaagtttttttctcctcccccttcacttattgccagactaaatttagagaaagacaagtgctgtgttgccaaatcgtgaaatgtgtttgggcgaggtgatgagagttggtttgtgagcagtaagggctgctgctatttttgccaagagaagtataatatacatgactctttaaaaattatctattgtgtgtcttttaagcaatcttggttttaaaatctattgtgggtcttttatgcaatcttggttttaaaaattgaagcattctttaacattcatcagttgtgaaaatttttcttaaaaagggggaatttatctcattcctttaaaaaataattttataattacataaaaatataatattttataatatataaaatatatcaattaatataatttataggtaaaaatttatgtattaatttcaaaatagtaactgtaatgtggattataaaaacagtttcaccatgtctaccaggagatatcatcccatcatagaaagccggttcgaaactaactgaagatatgatctcttactggtttatattcttctaaagttttgactggctagattcattgaaatctagattcacaaggtattttcatttatatggtcatatttaattgcatcccctagtaaaaaaaatcatctagaatatttattctattcattatggtgtaacaacttgcatttgatttttttcatactgagaatttttttccctactctactgtgctatgattacatgaaatagctatgataccagcatttatagaatctaattagagtatgcctatgtggagaatgattccaggattgaaaatttcttgcgtaaaatgctttaaaatattcttccaaatcaactctgattttgaatttaattgtggtggcccattactgcttttaacatttctggactacattcttggcattaaacttgtcttgggagtggaaggaagaaggaaaaaatatcccagtaactagtaaacaaaaacaggcagaatattagaaggaaaatattcatattcatcctaccacctctccctgctgccatttgacctagctaccagcaacgtaaccgagcagcttatttgaagagtctattatactggttcaaggactgggaagcagactccttgggttgaaatcccagctcttcacttacaagttgtgccatcttaagcaagttactcatctggaagtagtttaacaagcaaataacctagcatgctggattataataaaggtcaactggttaatatgcatgggtaaaccacttaggacagaacacacagggtacacaaaatatatgtgtttctaaagtaaaataatctcattccttgtgatttataaccttgaaataattatatccatttaataatctactcattcacatattcagaaaacatttacagagtactataactgtttttcactttttttctgggcctagaataattttgtccaatgtgacaagcaacaatttttgtcgacacattgtaggtattaagaattgaataaaagagaaatccagtgtattccatctacttctttcatatactgaagtggcattccaaatgaaatgttgtctaattccgtatctgagccaaagtggtaaacccaatgctggatcatgtagtcttaatatgcaagagcactgaagagagaacctgttttagggtatcccccaggacataacagatatgcagatctgtctgatcaccttgtcactctgctacagccatgctggtctccttgctttgttaggacatgtcaaacaatcttccacctcaggagattcatatttgctgctccttgtctagagcactccacttctcctaatctccctacttctatccctgctctgacacacaatctgcttgacccatgtcctcatctccttcaggtctcaactcaaaagtcaagttctcagtaagccttccttggaccaccctttaaaaaatagcaacttctcccatatactcagcatttttgtcctgctttgttttcctctttatcactatcatcttgtaatataataaatatgtgtttccttaagtattgttttcattttacatgtaaagacatatttattttctttatgtatcctttcccatacagtgtaagctcaattagaacagtcactctatttgtatactcaatgccaaaaacagtgcctaccacatatcacatgtccaaatgtttaataaactttagaataaatgtagttactttatctatttgcctgtgtcttgggctatttgctttcttttgtgcaaactaaatagaacctgcagcaacctggagttatgcccaatgagcactacaaattagtggtagttctctagtagcaatgggacatcctggtgctcagatctgttttttaaacaccttttcccattaaaaggaactgagatcctttgaagaactggctgatttcaggtctaaagaaggcgagcctgagatagttgtgtgtttgtgtgtgtgtgtgttcagaaaatacgcatacaaagactaatggaagtatgtcaaaggacatatggatcaacttgaaggagctttcactggcaaaatttgggatgacttgtgtactaaaaagaagtgagtgtaatttattttaatgcaacaaagaaagaaaaacacacaagtgtattaatattgagagagagagagagagagactgagactcatttgcaacactggaactaatacagcttcattggtttcagagaagacaataataagttaattaaatgacatgtccaaaatgtcaaatatgacttcagattttcagagcgtgttgcagattaattggcagaaacagcatgtgtgtactttctataagctctcaacatgaagggtggaggccacagacttaacagaagagggagcaccacacaaaacagtagcatatcttattctgtatttttttaaattaatgataccctacagagtgggtacatagctgtcattcacattctctgcagcggtgagaaaatagtcaatttcttgctaacaacaacacaaaagtggtttatacttagagcttagatcgccattctggaatgctaaccatctatgttgaaaaaaatgtttatagacatccattcttctgcttctcaaaccacatttggtattagcaggagtacattctcaaagaaggaactgcagaatcagtaactaggttccataggcagtctctatttctaggttatttccggtaaatgtgaatctccacactcagatttcagtgctttcatcttgtgattctgatatttggtttaaccaccacaatcatgaagcacgcctctatctccccaactatgaatgtatactcccccaaagagaacagcatgtctttaatcactgatgccaggggcttcaaaattgttaattaaaatgctcctgtagaacagcagttaatcctagtcctcaatgatattaaattatctttaaaatatttattgtggttaaagaagcttttatcgactccaaggtcctactgtggtcagtagttctttgtaacctaaaaacagcctaatatcataattgaaagaaaaaagaaacaatttgtaaactgctctatgctggaaacactcaaagttggatttgaatcattgactttcaccctgttattagagttttacttaatatgtccagatctgagatcataattttggcttacaactagacagatggtactcaattacacatttaatgctacattttctaatgtaacaatacaaaaatagttatcaggggctgcatatccattttctgtagacacccaggagaaataactttcacatttcctcttttatcatctacttctgtgcagccagaaggttgcatgccactccttaccatctgtcaatgtattgcttgctaatatatttttctttaatcagagaattgatgggacattctggataagattctatttaatagcaaaagatgatcattttttaaagaattagattatacttgagtactaaaattacatgaaacattattgacattctccttaatatttcagatggctcatcagttttgatattccttgtattttttttaaagaaagagcttacaaaaatcccataaaatagaaaatgatcagaatcagaagaggtgatccttatttctatgccactatgttcaccatccctggtgtaaaagattgcatccttctattaagaccaattgaatgcaataaaaaattgcaaaacctactaagtacctttttagtcatatctccagaataccccatgacttttcagttcccatgaataacacaggtgtaaataaaattttgcctgtagttaccatggtgtttttataaatgttttattattattgggaaaaaaaaaacaccactcttctgatagggcttgcatgcaattagtcacgtgtatttatagaaacaaagtcctaatttaactgatacttttatggttcaccttactcttacagatgcaaagtttaattgtttgctgctgtatgcctttgtgttaccaagggttagataacatgtaaccaaaaagactttgatttttctcctcttttcatggaattgtattaaaactaatttgaatgctaaataaattgatgtctctcttggttctgaaaactggcagaatattttctgtgaagcaaaagaacacacactcacacctctgcaatttatgtagaggatggttatataatcatttcacacagatgaactctaaaatttaaaatgaaatatttgtgagaccactgacttttaaatcacctaagaatgttacatttctatcttgttgttgatttgtaaatgcacgtttaatcattacttttcaatatccccttatccacaatggaaatagtttctgaaagtgaagatatatgtatttaagatatctggaaactatagatggtgaatgtaatcgttccaccaaatgattctcaccactcctctcatcagttaggttttatgacaaagcagatagttacaaattcattactactgctgaacagccaaccaatgcaagcatagtgctgtataataatttttattcaaagtgtttcatgagaaatttaaagtctcaattaagcttatgagtcttagattataaatattggcaatgtgatcacaccatatttaacaggtatttatgaaacatttattttgtcatcagcactatgatagacatcggtgatataaaggtgaacagaaagatatatgggctctgctctctggaaagttccattcaaaaagagaaaaaacaatatatataaatgtataattatatactgagataacctgtatgaaagaaaaaatatggggttataaacctataaaacagaggaacatgatcatatctatttggtcaggaaaggctgttatattagctatgatgagattcagttgcatatgtaagtatcacgaaataagagtgacagaaatgagaaagaagtttactactcttttataaaaaagactactgaatataggtgttccaaggtcatgcacagaagctgcaagttgacaaaggtccatactccttctcttttgtttctgccattttaagcatgtgcttccactttataaacaaagatggctggttgagccccagcaatcaggtttgcattccagttagcaagtagaaggaaagctttatgcaacctgttcccttacattagcaggtgaacacttagtcatacagccaaccatagccatcccatttcacgtgaccacaccagcttcccttcagttttaagttcccttacaattgaagggaagctggtgtggtcatgtgaaatgtgcctgattaagaatggggtgtccttcaataaagcagaagaaaagaatggatatttggaggcaggtagcagtacctatcatagatgtcttgagaaaatgactttggatctgagatttgaaggataaagagatgttagccagatggagtgaggaagggaagactgaaaagcagtccagacacatggctgcaccagcctcacttgcaactgaacttgaacttcctgtatccagcagtctttatgtgggaaacaaaacttctttcagtcaatgccattttgtgatttttaacatatgtgattgaacttaatcctaccaaataaaacaaccgttgctgaccctttagataaggcctacttattctatttttactgtttttctgggtctcatgcatgactaatggtttttgttttgttttgtttattaataatagcaggtttactcttaccatgagtttatgatagcatctaatatcacaaacccaaaagtaaataaatctctatcaaggctatataaatgtctttagaatgcatacaaattttataagtagcttcttgaagtatttcttattgctgaactataccaaagattttgaaaacttttagataatcacgtcatattttaggaaattggaaagcattttaaaacaagttattcaactagtatgatttcatctgaaaatattccctgtattttttttggagggagggattggtaatttattcaaaataatttcaaatgctgttaatccattcatttgtttttgacacatccagactcagcatgaatttttttataatacagctgaagatactagaatttcacatacatataatatttcaagtataaattaattgagctgtagagataagaaaataaatgtttatctaattttgttactcaggataataaagtgctttactaaacaggctattttcctttgtagatttacttaataggaattcaaattctttcaacagaaaatgtttccaaaacagacaaacattagaatatcttgtctttcataaaataattatcccaaataatgagcttagtaaaattaacattcctctgcttagaggaaaaccagacattatagtaaaatatttcacttttaagaagagcttttaaaaagtttattcttttattgttttcctccacattttctctttggattggttccctcctgtatgaaaggttcctatcctgtgcacagtattagcaagtagatataaccgtcaaacatatttttcctactaagaagaagccattggcaaatgccagagagcattcattaaaccaccataataggaaatataaccatatgagtgagttgttcaaaacaattcaaagaagaggaggttggacacctgttgacaaacaacatagaagtatataatgtaaactttttagaaaagattttcagcaagaaagtttcattaaattgattgaatgtgaaagatattgatgccttaaaattagagtatttatgacaataaagtatttaggtaaagtgaggtgcaaagataaattgggtggagaggaagagcaggttggtttagctagaaaggccgtgttagcagtaatgaaatatagatgaacataattggttactgtgaacttgtttagtgacaacaaagctgactttcaactttggcagttgtatcagttaactattgttttataagaaattatcccaaaatttagtggcttatggcagtgattatatttagcctgtttttctggttcaggatttggggatggcttagttgagtggtccaaccttgggatctctcatgaggtttcagccagtggtcagcttgagaagtgtcatctggaatctttctattacgagaagatccacttctttcattctgtgaatgaaaaaagtgtttcattcacaggaccagcaatttagtgctggctatgggctggaggccttagtgactttctatgtgggcatctctacagggctgtgtaagtgtctttaagcatggtagctggtttgtgagcaatcaagagaggtaggtagaagctgaaatgccttcatgatctcatttcagaaggcacacactgtcacttgcaccatataatattcacacaaggtgacctctaatttaatgaagaaggggtctacacaaaggcagacatatcaggaagtgagggtgtttgggggttgtccttgaggttatcaaccaaattaggtattattattatcatcatcatcaccatcaccataatgatgaacattagaatatcttgtctttcataaaaaattatcccaactaaccagcttactaaaattaacacccctctgcttagaaagaaactgtaagttatagtaaaatatctcacttttaaaaagaacttttaatgagtttattttatttttatttaaaaagtttcatgacgaggatgatgatcaacatttttattatagaaaggctaatacttagtagcttacatcatttctaatctttataaaatttctttatatcatttccaatctttataacaattctgtgagataggttttattattttcattttatagtgagagcgtagttaaataacttgcccaaagtcacatggttagtaaatggtagcatatctgtccatctgattcaaatctcacattcttttagccatatcatgatgcctctcaggaaatattgtctgctctgggctgattttgctagatatcataaatgcctgtatagtgattgatacacctcttaaatgaagcacaaagtacaggagaaggagacactaatcaacatcaataattcaggtactttaaagtattgtttcccataatagttaaaatacatttaaaaataatgctcattttacaatattagaataagattgccaattttcttctaagtgaagctaaattgaaaaaaatcatgagacaagttattagtgaatatttagctggtcataagcaagtgctttctttacgacttttctaatattacattttttgtatcaatttgtaatttcgaacttttataaaagcaaaagtgacactcataataggccttattattgagatgtagctaaaggtaaaaagataatgaccaaatccactaggagggattgtgtactcgaggaatagcaaccacataatacccctctagtaatgaacattaattgttttaatcaagctctaatttgaaatcagaattttaaaaaactaatcacatttattgtagtggataatttaaagcttttgtttcattttaaacagattctcagtgacagataaatcattatttaggaagagacgaatatcattcctgacatggcaatatattaagtctaagtctggaaattcctggacaaacatatgccctaaaggaggtataagctaaaggtcattattacagagggctgttccacaatttaattagcttattttcatgtgaaaaaagtagtttggtatcctcacaatgcatacatcaattggagttacaaattggcttacgaaggaaataattaaatgacttcatcacacaaatcaaagcacatctttctaaaatataattatttataactgaaggaaggctctgtgaatatttaaccttccattcaccattcttcacatagacggtaccgtttgtagtgctaaaaatactccatctcttatacactattttccaatttgtgatatttttgcataggcatcacctcagattcagattaaaaatgctaattcattttctcctacatattttctgcatcatctctggaggtagtcttggtagtctgcattttggataattatgcattctgaagttcgagaatcactgtaacaattccaaggatcttttactctgatccaagagagagaagagataaaataaaatgcagccaataaaatctgaaactcacaggcaatttctagagagaatttgaattgacagtaacaattaattatattattaaggaacaaagtatttcatttaaatatttgatactttgtaatgatattaataaaatagtactgtaagtacacctgttttgcattcgtgcatgtcaagcctcatgatgggttctttacatatgcagtatctcagttcaccttgatgacaatcccttgaggttggtattcctatctgccccattttacagatgtaaaaagtgaagttagaaagattaaatcccttgtccagaaggtggtaaagaatgattaacactcagctctgtatgacttcaaatgctataaggattccatactaataactttagggaaaacggtttgctattaaaagaaaattgaagctgatttgaatagcacggtatggttgaacatcaaacagattgaaatggaatatctatattttatatggtatttatataaagtacaggtagcctgatattaaatacacattaaatataaataaatatattttaaattttaaaatattttaaaacttttatgttaaaatgcttacaataataaattatttccctcacttataacttctctctaccaaataaacaaaaacatcaacaactacacacatgcataaatgataattatatcctgttagatacttcatattctatagaaacgatgtcaactttaatgaatatatcgccaacataaagcttggtacaacatgtgctttgtgccctttgagataattacatatatcctttatatatttagacatttattgaacacccacaatttgttcacctaaaaaagtgtatttttttccttaaggaactcacagaatcatgggaaaacagatatgcataattaaatcagatatgtggtaattattataattgaggtaagcgcaacattatatgcaatctcaacaagagtaatggtgaacctaaattgagggactgtgacacattcatatattgcaccggactctgaagaaacagtgagattttagcacacagaagtagaaaatggggaaaggatggcacagaaagaaagtgttagaagaagtgaggactgtacagatgtcatagacacttttttttttttttttggtcttaaaggaaatctaaaatctccttgagcacaatctgtggtgtaccttgttatagcaggtgggacagtgttgggacaggggttgagcaagccaggcacaagaccagcagatcacagcatatacatgattaaacgaggtccagattgggccagccacattttctctgccttgagtagagggctgtgagtacagttaaactatctagtgatggatgacattgtaaagagactgcccttcagtgcattctagtacagagatctccaaagctgctttgattcctccaggactttacgcgcaggtcctcttctctgtgaggcctctcctccccatatcatttaaactgcacactctaacactcccttcccacttcctatgttccctatttctccttagcttttatcactgcccagcatgctatacatcatcctatttattttgctattatctattttatcctattagaatataagctccatgtttcacttccttgccgtaatttatccagtaactagaatagaactttgtacataatagtcacgtgagtcaaacaaaacaaaacaaaacgaacaaacaaacaaacaaacaaaaacaaccctgatatttttggttttctttcagtgtttctgtatcattctgatacatttttattttgtttaatgtgcccataagtttctgctgctttcaactgcaagcctcaactgaatggtgttttaaaatgtataaaatgccttccaatatattttctcttcaaccttgagaaacatatttactatttttattactttaaaaataaactgaacctcggggaaattcaatatttgcatattaacgtttcaagtttagatataaggcccaaattcatatttcctgctccttgcattttgtagtccgcctcatctagaaaatccccaatatcgagatttgactaagattccatttttaatgattattttactccaatacttattgattcatatttatatccaattgaaacatcttgtttacattcacttttatgtattcccacaggtttctcaccagacatggtgaacaataataatgtattcaaatcaaagagtcttgcttttgaatagatggaattgagtttctcttccatgttcttttcctcagactacataatgcctgtgattttcttcatcctttcttcttaagatctatttttcacttagtaaattatattggcagcatttcatattaaatatttctctatattttttgaaaatgtaatatactaactggctatattaataaaattagattaacgcaatattaaaaataaggctaattttctaggcctgtgagtgtatttgacccttctctacaaaagcacaaattctcctacctttcgtttagcttataaaaaacactatgactgtccctctcatcattatctacaatggttgatgtgctcacacgtccttcaatgcatgtttcatactgctacttattctttcttattagatatatgtaaaagttaaatttggggattacttaatagtgcaaaatatattaactttatttcagttacaatattttacaaggtaaaaaaaaatcttcaaatttgtattaccaaataacatctattcacttcacatatatttttggagtgtcacatatgatgaaatgtcctgggaatcatcattgaataaaatacattttcttggaatttatgtctgtaacatggtactataataacattaagcaaagtacaattttccggggagtttttctatttttttgagaagtgaaatatattttcaataaaaatatcacttcctatgttcattacctaaagaataacccatattcagtcagttcaacattactcattgaaaccttgaattccttgcctccttaatatttcgtggcatctgccaatacgtatttccatttcaattctgtttagaaagataatcacagaaatctacttaaaagacagctacacatctatgcttccaattgcaccttgactctcattgctgctaacatctattatcccccaaaaagacattatttccaatatttcccactctcctgaagcatgcaacgtcattcctgtgccatttacttttggtacagtgattaggataaagccatttgatgtaaattgtttcaaaatgctttctatcaagttttattacgtctctttacccatcttctcttttccttttttttttctaagaaaatgaagcattagtcactacaaggtttatgtgctagctcttaacctcacccttttcaatttcttcagcattctctgccttctatcaataaatacagtaaagatcagagaaaatacatattttccttcttgtcatgcaaataacctagaagaatatttaaaaataaatataggatgtttaagatttattaaaacaaattggccattgctttttccagtaaaacatgctaaaacagaaactagcctgttctcagaacaaggctcttagctgatggagtattcttcataattaccatcaccaatgggttgtactgaatgagtgtgtctatgtgtgcataacacaacatggagacagggaatggcatccctaaagatctggaggcctagggtccacagtatgttttagaacttcaagaaggtaaagaaaacaaaaattctagggaatgtctgccatggagaagctctgcctagaatggtccctcagttcatggcccattggccagccataaaccatggctggtatgtatgtattaataaaatacttctttacttatgtttttgtaatataattatttcaaaattcctcaagactttttaaagaataaaattcttcctcaaattctttctcaattgacacatttagaattaactgattcttttagcacaatataactgcatcttacaatcgtctattaaaatatttgttttaacctcttatgctttacaaaaactgctccctgaaaatatacttcacatctaaagcaagttcttgataagtgtttcctgaatgaaagaacagtgtatgcaaatatttgaaatatattgttgttaaaacatgtgattccttatatattaaatatttaacattaaacaaaattgtgttaaaacaaataatgtagtcagacagtgataaattataatgctcgaaatacagttaatgtataatattttatttatgatgccatatatcatttaggatttcaaagatggcttcattttcagcatctgtgtaacatcaaccaactacacctatggcttcttatagtcctattataacctcagagctggatcatcttaaaaagagcagaataataatgtgccaaagaagacagaagtacaggataaagtatgctacagttatacatcatctaatgactggcttgtgttctgagaagtgcgtaattaggtgattttgtcatgtaaacatcatgacacaatacataaatctagatggcgagcctactacgcatctagcctatatggcatagcttactgctcctaggccacaaacctgtacagcatgctactgtagtgattactgtaggcattgtaatatggtagtaattgtatatctaaatatatataaggcctatctaaaacatatggtaaatatatagcataaaagaataaaaagcattatatataatatatatatttattatatacaataaatttattatatttacatattttataattataaatataatataattatattatataattatatattaattatatttatatataatatattatatattaattatatttatatataatatattatatattaattatatttatatataatatattatatattaattatatttatatataatatattaattatatttatatataatatattaattatatttatatataatatattatataattatataatatataaatataatatatataatatataaaagaataaaaagcataaatatatagcataaaataataaaaaagaataaatatagggcacttaccataaatggagcttgcaggactgcaaattgctctgggtgaattggtgagtgagtggttggtgaatgtgaaggcctaggacattactgtacactactgcaggcatagtaaacgatgtacacttgggctacactaaatttacaaaacatatttttcttccttcaatgataaattagccttagcttactgtaactgttttactttataaactttaggttatttttttcactttttgactcttctgtaataacacttagcttaaaacataaacacattgtatagctggacaaaaatattttctttctttatatccgtattctataagcttcttttctatttgatttttgtttttactttttaaacttttaaattaaaaataagacacagacatgcacattagcccaggcccacagaggctcatgatcatcaccaccattgtcgtccacctccacattttgtcttacaagaaggtcttcaggaacaataacacccacagagctgtcaccacctatgataatagtgccttcttctggaattcttcctgaagtacctgcctgagactatttcacagttaagttttttttaataagtagaagtacactccaaaatatcaattaaaatattgtatagtaaatgtataatccagtaacatagaagtttattatcattatcaagttattatgtactgtacataattgtatgtgctatacttttatatgacttgcagcatagtaggtttgtttacactagcatcaccaccagcatgatgcattgtgctatgacgttatgatgtgtatgatgttatgatgactatgatattatgatggctatgatgtcactttgtgatagaaatttttcagttgcattgtaatcttataggaccaccattatatatgcactttgtcattgaccacaatgtcattaagtggttgtatgactgtatatacaaacattacactgtagttcagaactgttgcttttgcattaattttattttgtagaaaacaaccaataaatacaatgttttctatgaatcatgtgtcttttcttcaccaaaataattacaatcaagaatatttacgatacaataattaggttatgtccattgcttcctagtgtcattgtccagttttctatttaaagttgctgaggtttgctttttgatataacttaaaatatcagtttgtgatattcttttaacatgccagtaatagcattgactctttttgactcccagtgatacaaatttctttaaatctttacatgttgtatgcagcacttagcatacaaagtcagctattctcttttaatttgtagatacagtaaattatattttaaaattagctaaattcagaaattggtaattttaatatacatatttatgactataaaactaagatggtaataaaagtcataacaaagattcaatatggtaaacttcaaaatgaattatataacacaatttaaaaatacacaagaaatgcatttataaagaaatacaagaacactttcaaaaggatacttagcattctgaaaatttatattatataagcacaaaataatgtatatattataaggatcttgacaagtcaatatattttactgagcttccctaattgatatataaaatacttaaagtagtgcctgtgctcacttaacattacatttctctaaatttaagataagccaataaaaagattatttgtaatcttgaaataaattatgctattatttaaaaagtaccttcatcattaaaacaacagttaatcttgagttccatctttactggaagtaaatacttttacaagattccatatatattccattgagcttttagaataaccttatgacctaaatattttttttattttccaatggtttaggaaagtaaaaatagagaaataatttcacttgcttatagtcacactctagcaaactgtagaacctgtttttgaataatgtatttaattccaatggtcattgatatggtttgcatctgcttccccatccaaatatcatcttgaattgtaatcctcacatgtagagggaaggacctgtaattcccatgtgtcgagggaggggagtgattggatcatggcggcagttcctcctatcctggtcttgtgatagtgagttctcatgagatctgatggttttataaatgcttgacagttcttccttcacactttctctctcttgcctgccacttgtaagacgtgccttcttccccttccaccatgattataagtttcctgaggcctctctacccatgtgaaactgtgagttaattaaacatcttttatttataaattacccagtcttgggtagtattctttataccagtgtgaaaatggactaatacattaatgttcttaactattatgaattttttagaataattcttgttatttgtaaagtattttgaaaatataaaaggaaaaagcaataaaaatggtagcaaagttaaatatgaactagaattaaaagtaaatttggaagtagaattatgtaattgaaattacccaatttataataatattgtctgtatgtacatttaaagtcaaagcacttctgtttatctgtctactctagagaacagaataatatgctattgtgactttttgatagttttccttggggtaactctaagatccttgagtgcagaggcctagtgtttttctcaacattgttgaagtctgacataatggtgcctcacaacaaggtgtgtcaaagttagcaaactaattttagtctaaaatttaaatatgaattcatttattcattcaaaaagcatagaaactttctatatgacaggcattatgctaggtgtcaataaaaatgtgaccagttaagtgaaataaattatatgctctctaggaattcccaatctagtggtgcagagagacaagcaaaaaactaagggtagtataataatgcaatacacatatctttattatggtaaggaagtataagaacaggagaatttatcttgaattaggtttcagggataatagtccaggatggggttgaatgggaatataagcttccagaaagtatttataaaataaagctaatacacacatttaggagtcaggagtatctaactttaagtaacttcaggggtaatattcaaggaggggtgataaggaaaacaacttccaaaatgtacttacaaagtaaaccaagcacacacactcaaaataatgataattctgtgtaagtgaatgtgtccagccccaccctactcccaatctcctcattctctgctaaagccatttcatctacttccatggcttcctctacccagtaaccagatgtctcccacattaacatctactactcaggcagacctctttcctgagagccaaacctgtgtttccagctgtctaatcaatctgttcaaaactgaacttaatatattgttttccaaacggctccttctccatattcatctctccttcactagaaatattaaagataaacctgacctttcctcttttgcctcttataatattcagcaactttataaattcttttgaattatatttattatacctattaaatatgttttactttctcttttattagctcacatccttgccaactctagtgtgatctatggaccataccataccactgaaaccactgtttcagtagctgctttattgggctctttctaaccacctggactgtactcagtgtattaaatactttatatcaagaacttgccaagtcatttacatacttccaatttctttcccctccagatgatacctgaaacatagagttattttagctaggtacaagtgaaatacacttgtatgcctaaacctgagaatcataaaagcatttatgtgattttaaggaggttgcactaaatcagaataccagcaatgactatatgacactaagtaaaacattcttcttcttaatttgtaataaaattcatcacctatttactaatcatggttttgtattaggcaatctgcttgatgtctgtgaattaacaatgagaataaggatgcagcacctgccctcatataatatacagcctagctaacttgtattaggtagagacttctgcaaatggaagagttataacttcctatctggagccccaaaggctactcattgatttctatggttgctatcactgatatacagaacattcttaaaaaaacaaaggtgtgtatttatgacagatgttttccttgagttgccctttatatctttcagtgcaatttcaggatataagtttattggaaatttgattataataaatatgtatttgcaactaggaaaatactatcagtaacgactacatgagggggtgtagttaaataaaagccttaaatttaaaaatccagtgaggcaatgttttcaagttatggagacaaatttctgtaaatgtctgccctaataggtaaacagtattggaaattacatagtttagaatacttttgttgctgcatgtaataattaacagtttaggcagcagaatataatggaaagagcatggatttttgtgttttatagctctggattcagaaaaactatattactccctctttgcgttattaaatgctgatttgggtacctttatggaccttcattttttcatctctaagtgggaaatcatgacaactcatctgcattttttttaaaagctactgaattgttccctctgttctcgtccaaatcccaaccaaggaaatatccagtattctaacagcaaatccaagctttttttcactcctcactgaaaattcttaaacccaaatccaaggtcttagggattacagttaaagctatctttgtattttggaggttgcatactttatttttagccatttcctgtctctaggttatgttccagttattttaaacatctcttgtattatctctgccattcataagcatgaatgcatataattgggtgacagagcaaaatactgattctctctcttggctgggaaactctgcctatattactgggtaatcttgcagctaagaggtattttgtatcatctgtatattgttactttgtcttcattaattttatttgaacacataacacatgccaagcattctgagaggtatttccagatggatttaaaatttatctaccataagaagttatatggtcctccaaataatagaaaaataatggcagactcttaggtagcaacaaaatgacagaatgtagaaaatcttgttctttgatgaaaagccagaattacctcaacctcatttgattacagagatatgatgctatccatatactaattaccattagtatcttttttctttttcttttttattttctttccaattttatttatctatttatttatttttgaaacagggtgatagggtttggctgtgtccccacccaaatctcaccttgaattttaactctctcaatttccatgtgttgtgggaggaacccggtgggaggtgattgaattatgggggtgggtctttcctgtgctgttctcatgatagtgaatgagtctcacgagatctgatggttttaaaaatgggagtttccctgcccaagctctctctctttgcctgccaccatctatttaagatgtcatttgctcttccttgcctccgccatgactgtaaggcctcctcagccatgtggagctgttaagtcctttaaacatctttttcttcccagtcttgggtatgtctttatcagcagtgtgaaaacggactaatacagtaaattggtaccaggagtggggtattgctgaaaagataattgaaaatgtggaggcaactttggaactggataactggcagaggttggaacagtttggagggctcagaagaagacaggaaaatgtgggacaatttggaacttcctagagacttattgaatgactttgaccaaaatgctgataatgatatggacaataaaatccaggctgaggtggtctcagatggagatgaggatctctttgggaactggagcaaaggtgacccttgttatgttttagcaaagagactggtggcattttgcccttgccctaaagatttgtggaactttgaacttgagagagatgatttaggatatctggcagaagaaatttcaaagcagcaaaacattcaagaggtgacttgggtgttgttaaaggcacttagttttaaaagggaaacagagcacaaaagttttgaaaatgtgcagcctgacaatgctatagaaaagaaaaacccattttctgaggagaaattcaagccggctgcaggaatttgcataagtaacaagaagctgaatgttaatccccaagacaatagtgaaaatgtctccagggcatgtcagagacctttgtggcagcccctctcatcgcaggcccagaggtagaggaggaaaaagtgttttcatgggccgggcccagggtccttctgctatgtacagtctagggacttggtgccctacgtcccagctacaccagctgtgattaaaaggggccaaagttcagctcaggttgttgcttcagagggtggaagcctgaagccttggcagcttccacatgctgttgagcctgtgggtgcacagaagtcaagaattgaggtttgggaccttctgcctagatttcacaggatgtatggaaatgcctggatgcccaggcagaagttttctgcaggggtggggtcctcatggagaacctctgctatggcagtgcagaaaaaaatgtggggtcaatctctactggggaaccaccattgcttgcctccagaccccagaatggtagatccactgacaccttgcactgtacacctggaaaagccacaggcactcaacactggcccatgaaagcagccaggaaggaggctgtacctgtaaagccataggggtggaattgcccatgaccatgggaacccacctcttgtatcagcatgaatggatgtgagacatgaagtcaaaggagatcattttggagctttaagatttgactgccctgctggatttcagacttgcatggggcctgtagtccttttgttttggccaatttctcctgtttggaatggctgtattaacccaatgcctgtgcccccatggtatttaggaagtatgcaacttgctgttgattttacaggctcataggcagaagaaacttgccttgtctcaggtaagactttggactgtggacttttgagttaatgctgaaatgagttaagattttgggggactgttgggaaggcatgattggttttaaaatgtgagaacaagacatttgggatgggtctgggatggaaaaatatggtttgattctgtccccatccaaatctcatctttaattgtaactcccacacttcctacatgttgtggaaggaacccagtggggtgtggttgaattatggtggtgggtctttcctttattattctcatgatagtgaatgagtctcatgagatctgacggttttaaaaagaagagcacaagctctctctttgcctactgccatccacttaagacatgacttgctcctctttgccttccaccgtgattgtgaggcctcctcagtcacagggaactgtaagtctactaaacctctttttcttcccagtcttgggtatatctttatcagcagcatgaaaacgaactaatacacagggtatcactctgtcacccaggttggaattcactggtgcgatcttggctcactgcaacctctgcatcccaggctcaagtgatcctccgacctcagtctcccaagtagctttgaccacaggtgtgtaccaccatgcccagctaatttttttgtatttttgatagagacggggtttctctgtgttgcctaagctggtcttgaactcctgagctcaggagttccacttgccttggccttgcaaagtgctgagaacacaggcatgagccaccatgcccagctaagtatctttttgaataaaatttcttcatgcaattgagattttcagtttacatatcagtctcctatttcaggtgctaatcctatctgccaagtatgagactatatacaataaaaatttaaagttctcttggtaaaataagaaaaaccccaattaataaaaatggtaaagaggtattaaaaatcctcaaaaaggctttggctagctaccatagaaatattaaaaaacaataaaattaaaaaatttccttggtcactcatgtatctgttacatatttttaataatcttactttgtgtggtacacaagcaaatttacatttatacatctttagatactatccctattaataaatagttacgtctcactaactgcctatatagttaaaagaaaaataattagttgcttactgtgttaaattttaataggtaaatcatttatttttgaaatatattttccaccttacacacataatattggtctccatgtatgaggaacacagcttaataaaatggtcttggggattataacgaagcataaaatttgttttggtagcagtatgaacaaataaagaggattttttacaaaaggcatttaatacagtgtgcaggaatgggtgaaggcttcacagaggaggtagcatgtgagataagtctttaagaaaaattttccagtgggcactttgagtgaagaggcaaagacaatcacacagaagagcatgcaaacaacttttttaggaaagaaagtagagtgtgtcccatatcaggaaggtcttttttatgccaagctgggaagataatttctgtcatttaaggcagtgatcccaactggtggtacctgtccatggcctgttaggaactaggctgcagaacagaaggtgagcagtgggcaagtgagcaaagcttcatctgtatttacagctgctccccattactcacattaccgcctgagctctgcctcctgtcagatcagtggtggcattagatgctcataggagtgtgaaccctatcgtgaactgtgcttgtgagggatctatgttgcacctgccttacagaaatctcatgcctgatgatctaagatggaacatcttagatcccttccctgaaaccatcccttcccgtccccctctcaagttcatggaaaaattgtcttccagaaaaccagtgtctggtgccagaatggttggagaagagaagtattttaagcacggaagcaggaggttactatgtttccaaacctatagtaaagtttctttctcttgttttcagtaggtatgaagagttagccacttctatacatagttctgacagataatgttattaatgctaggattcaatggctaaacaaataaataaatatatcttaaacagaaataattcttctatgggcccaggagataaaatgccttctatcagaaattattcctttggtttgaagaaatgggttgcgaacttcgttttgttttgtatgtgatagtaacacactgttgttatttatgaaagtttccacagagaactcataaataaaaaatgtaaatgtagaatagagaaacttggtgagcctcaaaagaatgtttcgtagcctggtggggtggctcactcctgtaatcccagcactttgggaggccagtgttggaggattgcttgagcccaggagttcaagaccctggaaaatatagtgagacttccatctatacagaacattaaaaaagtaactgggtgtggtggtgtgtgcctatagtcccagctacttgtggggctaaggtgggaggatcgcttgagcctgggaggctgaggctgcagtgagcttttattgggccactgcactccagcctgggcaacagagcgagatgctgtctaaaaataaaaataaaataaaataaaaatattttccctgctgttgctagcaactactgacaaactcccatgaaagtttaggactgtgcagatatggtttgaaaacagctgagtgaaggtatttaatttcgaggaaatgaggggagccatggtggtggccaggatatctgggaggaggaacacattaagtcatgattaaccactcagtagggttagtagagcaaatagatggtgttatttacaaagataaagctatgaaagaacaaatgtagaatcatgttgagacatcatttttatggacataaaggtaacaaaattcactgtgtttatatatatatatatatactttaaacaaacatatatatatatgtttgttttaaagtaggttttccatttgtatatatttgagtcctacaaattgacacttctaatgcataagaatactgcaaatattattttcctctagtagctcttaattttaacttttgtcaattaaagggcattttagaaactacattctagaacttgacttttgatgagaagtcattcattagacatacagtgcaaattgagtgctggcatcatccagggtccaggcacctctgagtagaaaactgcaggcacaagtatattcacagtaatataaaactgatgattcacacataagggaattagcttaaattgagtgttacatattctattaaaaaaggcatatgtgtttgcacagaagtatgaatgtgtttgtctaaattaaagatgcaatgaagagcaaggtcttgtactaagaatatccttcaacttcttatttgttgccttttcacctttgaactgcttaggtcaaatacattctaaatcttactcttaaaatgtgatagcataccatgtcagaaaaaaatgacaggatagtttggatgtttaacgagaatatggagctaaaacacagtattattcatgctaagctctcttaaatatatttgcatatgttaactcctgtgctagaattattttaaggaagtaagcattaaaatcccaactccttgatgcagaatcattttagaagtacatttgcaccatttcataatgacaaccatttttgaaaatttaatcattttctcaagatacagtttttgacaaatggtctgttactttacagcatctcatttgtttttatagcatttcaaccaaagaaaatatgctgcctcaatatgggttaatgtatataggtaagaaaatcatttaattctttataatcaatatataattctaataatcattcagtataattgtaataatcatttaattctttcttttggaaaaaaaaaagccaagagttgactattatataccttaatctttgtgctttaaaaatcttctttctctctttcttccaccaaaggcaaaaacaaatgacaatagcaacaaaaagataaacatcaaaacttaaacacatattgtctgttatagacctcaggatcaaatattttaggaaattaaaaatgtagaagaacagagtttatgtttggtaaaatttatatcttatcttaattcctacggtttttacaagaatatgttattatcgacaaaaagggggtagttaaaaatcgttgcagtgtgttttcaaagaaagtcacctgccaagaaaggtgtcagtaagatctttactgaaagaattgtaaaaagcctctgtcatgaccgagcatatggaatgaactgacccttaaactttaagagactgaagtagaatacctaatgtcaaatgctacccaaagagccagctgcaggatattgtaagaggtgttcatatctcagtgtacagaggagaaaaaaaagtaataattctgtacagcagccccagggcacttgcattttgaatcactgccacaataagcagatcaccagtaggaagagaatatattttgtaaaaccacagacttgcactatcagtagacatcagtgtaaaacagaagaggcaacagaattaaaaatagaagtatagaaaggggagagagaaagagtaattatatctactgcctacagtttgcaaaggcaagagacttataattcagatgtgcatttatttagagatcccttcaaaaaattctgaccacctttattatattaattctctaggccgttatacttattttttccaagtatggtataattatacagccagaataattaaatgtcaggctgtctatatttccataatgtataatatacagggaaaagaatatcaagttcctttttcatgtaacgatgatatgactgaattacaaagtaaaccttaggaatgaaaggcacaatttgaagataaaaagaagatagaatctgatctagtttagacttagccattttctagactgatggctgatttattcacaggcaattgaaatacatttagtaggtaacagctttctaactcatatttatattataaatcattttgacttttcgataacacagaaaatcttccatcttaatgagtttctactctatttcaaattggaaagcatactaaacttggttcttaaacctcctgtattgtttattgtctttatgttatacacataagaaaattaaataatgggaattatgttaaactgtgtatatgaaatgcaaaatatttttctaagccaagaggacttagtttgcaaagttcataaaatgtgttttaatcttactctttctgcgacgcacaaggaaagtaactctacaatgtttaccatattataaccataaataacaatatcaggagacacaacacatctcataaaccttcaaggatgacactgtagcagatttaaaaattcctgtggaaaattgtgttcactatttttttttttaattcacagagactcctaatgccatcctatacccacagtttaaagtagattaaactgacatgcacattattcattccatacattttcttcaatacttccaacctttttaagtctttcttcctttatatagcactttgttaaaagtttgacaatacattaacttactaagtagtgaagccatttaaagcacacttacttgaaaagtgtaaaaccgggtcccattaggaggatgcactttaggggagccagaaacggtgttcatatccgagaaaatcatttctgatcactgagacaatataatccacaaggagctacagatgcagagcagagagcttagcgtacagataaatccgtgcatgcattgagggagactagagggtaaaatgaaatctgccccatccttcttacatacacagtgatagcattttgaattgttcttctacatttgaaatcttagctgaaagatcatcagccaccgaccttttgtgaagctagttctctagaacatacaatgttttttaaaaaattaaaaacacagaaggaaaaaagcaagaaccaacgataaatggagcttgtgcagaatctggcagtgctgtggacctgcccatctgttctc

SEQ ID NO: 448 - DNA, 340107 bp, Homo sapiens; identical to SEQ ID NO: 447

SEQ ID NO: 449 - DNA, 111150 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttattt

SEQ ID NO: 450 - DNA, 111150 bp, Homo sapiens; identical to SEQ ID NO: 449

SEQ ID NO: 451 - DNA, 254127 bp, Homo sapiens
ctggaattattattttttttattgacaatggaaagggtttctgttatcattaccttttgactgaatctgttaaataaaaatagacatcaaaacaaatgtaatgtacgtgcaaacatagcaaattaaaatacagaaaagaaattactaatgacaggtcttgcgcttaataagatcaagcagcagaaaatcagcagttagataaatggtattattaaataggctttactttgaatctcccatataaacaaagaataaacaacagtaacaccaccaaataaagccacagggaagagattactcttctatacttttatacactatatatgttaatcattctgtctttcatttatttcctctgataaaactgacttcagggaagtcgcaacaaggccatctcggctaaaagcttataacattagacatgagtctggctaatgccctgttacattgacaaaagggaaaggtatcttgggtttcgttttctctagtggaaatgagcctcagactctgcggtggttgacattcactgtccagtactggctggcatttcaagatatttgaatgaacatgtggttcttagtaaagaagtttttttatctttttttttttcttggtccacaggtaacaagagaagattatggttttttaatataaatttttaaataattgcttttgacccttgtaaacagcttggctttgttttgtattgaaaaggagatcaagccatcacagtgctatttctaaagatataggacatccctgattgcctttaaagctctatttttggctccggttccaggttaaatcattcttttttacatgatcagaggcaggttgttcagctttaagtattgacagacttgaaggagaaacacgttgaagcatgaaacatgcttcaaggaaacatattgatttgactattaacaatccaaaaactgtaaaaatggtggaatggtaaaatacaaacagtacttggaattgtcaaatgtttgcactcgagactccatgaaccatatattttattttttaaaaaatcatatttatatccatttacataagacttacacatttaaaaagaaatgcacggtaatacataaatgcctagtatattacaataaaacatgaaaaacaactggcttcatttcataaaagcatctgttgtacagagtttatgatgtagatgatgtttattattcaaatgacttaagcattttattacaatttgtagtaaactaatcaaatgtaatatctgactccccccaaaaatcacatttttcagcttttaataagtcatgacgtcattatttccttagaattcagttttcacaaaggttttcactgctcgtcttcttagatggtagtgcactttaggtagagtagactgaaaagacgccatctaaaatatacaatggatagcattagttcactgaaaagtcccagactgggaaatctcattctactcctctgtggtgtacctccacgcagcctgcttactcctgtcctagaagatcatgagaaggaaatcatctaggatgtagccaacagccgtatgtaattaacatttgcttttctccaatttggtgcaggggagcttaacaaataatagaatttgctcaactttgtggaaagtatggcagtaatgtaaacaaaggtagttatgcaaaatgttagcatgccttctgaaaaatttacaacttgctaattaataaattgggttgaattgacctatttcataatgtagatttatattctagttcatatattttagagttcttaaaaaatacctttatttgttacaaaaacataacgataataagtcacctattgtaaacgtttgtgtcagtagtatggcattgctgattgttttcagccataatgtacttagaaaaagctcacaattgctattactgacacaaaagaaacagcaagtagtatgctctggattattttaatatcaaaagtgttgttgtttcacccaaacaaaaaatggttgtcctagattgaattattgtaaatgaatactgttatcccaattaatggtaaaaactaggaaatatgaactagaatgtcatgcacaaaaaacagattgcaaatagagtaactctacccatcacttaagagctaagaagcaagcactattgaacatattaaatagtcatttgtaaattagtgaagtgttcatttcctgaagaaattataatgctatgtgtagaatctaatataaacagtattttgggagacctcttatttagccaaattattatatactttaaatcatgtctaattaggtgccaaattatataccataattaaaattttaatgtaagggttgtacattctgaaattaaatctcttatcgggatgcttttcattttatcagcttcaaatagtgatccaaataaggcagcatatctgctcccatcctaagcccaaaagaccaacaataaattgtgtggcacttttagttcaaggcaatgaaaacagcacaaggtgagttgttcctctgtctataactgttttctcttaaccctgtgcacacattttgttctaaatatcgctcttaaaaagtatttttctaaaatattgattcatcgaaagtggttaaatattttggtaaagcatagttttaggttgaaaaaaaattatgaacatttgacatttataaatctaagaaaccacagttttactattaagactgtttttcaataaaacctcatttttatatggattttaaagtagctttcattaattggtatttccttaaaatcaaatgcttggtatttatggttacataggaaggttttgtgctggtcctattctccattcttaaagtaattttattttgttcctatatgtcttaaatacttaaaatttatatttgtttttagcaagtgtaaatcagattgataagaaacaatgtaataaaggtttgaatttttcacagtttctactatttatttattgatttattttaagacggagtcatgctctgtcacccaagcttgagtgcagtggcaccatcgctcactgcaacttctgcctcccaggttcaagtgactctcttgcctcagcctcccaagtagatgggattatgggagtgcaacaccatgcctggctactttttgtgtttttagtagagatgaggtttcaccatgttggccaggctggtctctaactcctgacctgaagtgatccacctgcctcggcaagtttctattttttaatatgaaaccatctctaaatcattttcctgtctgttgctatttgactcggtgaacttgcttaaatccctatccgctaccttggcttccttatataaaatatacacttaaaaagataggattttttaaagtgctgaattattatcaataaaatgctaagttactcaacaggaaatggtactaaaaagtagaaaacagtgtagtggcaacccattgatgtgtaataatacagtgataggcctccaacaggcagaccttaaaccacaggagacagatggtgataggaaatgctagactaagtgttacaatatgaagatttctttttcccctgaagcaattcaaaagggttatctcatttctgtactgctagggcataccaaagagtatagtgtatatttattagtctatgtaggttccatttttttgtctttttttttttgtcagccaaagggaaactactcacagcaggtcagtgctgcctcctttgagtggctggtcaacatgagtatgtgcgaacagtggagttgtctaacctctgcagtcttgatgaagcaactgcaaatggagaaaagggctttagagggacttggatgattgagtacaagatttcagatgagaaagatttattttccctgcatacagggattccgaacatattagtagaccttctttctctcagatataagccactcacattcctcttctctagatcaagttcctaatgaaaatttatcccaatgtaaatgacctgagcttttgagttgttatgtattcttccttagataaaatcggtaacaagagcagctcccgagggtgcttctgattttgatatggagattgctcttagagaactcattatagtggattttttttcctttccaagtattgaagaacttctacactaattgtaatgatgttaaattcctcatgaatttcgctgacatgttccaccgtattaacaagttgtaagaaatgtagatcaagatcacagtttatgttggaactaaatttgagttataataactgtgaccttgacaagaaataatgatgctaggtgattatcttaacaaatagcatgggactatttttctttaatgcctcccaaacagaaataattttgtgactactatttcaaagttgtctctcctctggaatgacttttcttttgtaaattagatagcttaagtctaatgtccacagaaggaaatagtaattgggaaattactgtgttttgtgtttctttaattctcttctcatgttcatggcttgtttatttaagggcttctgctttggctagagggaaaaatatttgatgagtgaatttctaagatgacatataaaactcgcagtatttaaacatgtagggagacagtggagttaatttccatttactatggatctttagtccaagtccaacctctaacttaaacaaattgttaattttgggaatagaagactaaagaaacacaaatcctgccgatgtttattgttcctcctagaggtggacattaaccaaattgttctttttgggatgttataaattattttgaaaatgtgaataaagtgccatgagttcatgcaatagcagtgtaaaaaggagtctggtttgtgatgagagcaaagtaaatttcaagcagagcaaaccaactcaagaaaataattccaaaaagcaaggtcagagaattatactagctttggctaaacaagctttttgcttgataagcagcaatgcaaaactactgtaccatctgttgtcatttttcttgactgcccagaggttgtggttaacctaaatccagctggtaatgtttctgaggacccaggcatcatgctgattccatgtacttcacgaggaggaaactgccttctccaggttgatccacgtctgaagttcttgtcatcactctgccagtacagttataaggtgatgttatgaaaacaagtaaactagtccatgtgcttaaagctctgtgcttagaaacatgtaacatagattatttacatttagtctgtcaagtatacgtatggaatcacgctttatcaagatagttagttctatgattccaaaacaagactataggagatttgatatataaatttttaaataaaacttttcatacaatttcaaatttaaggtctgacatctatacagtaaatatccttgaaagcctaaaataagcaaccaatgttttccaaaataaatattgtatatacattgttccactttatgccgacgggttttatggaaagagatgatatacttaattgaatcagttgttgagtagactacatttaactcacacacttgaatgaaatgacttctatgtacacaaatacaatgtaggtatttattttggggaaatctatatttgagatggcatggctaatatgagacactgtagcctattataatatctgtacaagaaactctaaatatgtgatttgtgaagttttaggtgacacagaattaacttgcaatttgttgaaaaatctgtgtagcctggacaccatcctttcaataagtacatgtggtctttgggtaccaccgaaagcataatattaccctggttacattttaataatgtgtattttaatatacacagaggcagagagtcacatcccatttaattggcccagtagactttttctctagttcattactatcaggaagcaacatcataccccacataggctagtgtctctacttggacagatcctagggtgaatccacattttagaatgtagcatagcaattacattttaattctggttgctgattttgttatgccttaataaaataatctcttccttctctttgtgtacataaagtacttttacagacataattattttcctccaaattggcaagtagcaatatataattcagcagtcaatgaatattctgtgtctaattccaaggaaaatatgaatcattccacataggtcttgtcttctcatctcactgtttcttatctagggaaggactatctatgccatagataggtatagccaagtatatgttgtgtatcctaatatctcatttgatttcattctggcatttggaataataagtctatattcactcaacatagtaatttgtgctatgttatagtgaataattctataaggtaggctttgtagactgctatattaattaagggacatttaaagtcaatcagggaaaaataaaatcatttttatataataacatatatccactgtttcaatccttatcatcattaaaatctacattttgtttcagtgtggtagccattttgcacattaagagatgtccgctactcttcccaactgctgtgtttttcattgccctagatctccaaatgtgtgtaaatgtagaaaagaaacagaatttcacagttgcagcctctacgacttcttgattcttggagaagtttttgcattaagcataaatagtcttcagttttataaaacactatgttacactgtagagctacacaactccttacagtgtcgtagctaggggcttaaaaataagccagttttggctgggcgtggtggctcacgcctgtaatcccagcattttgggaggctgaggtgggcggatcacctgaggtcaggagttccagaccagcctgaccaacatggagaaaccctgtctctactaaaaaatacaaaattagatgggtgtggtggcacatgcctgtaatcccagctacttgggaggctcaggtgggagaatcgctggaacccaggagacggaggttgtggtgagccgagatcacaccattgcactccagcctgggcaacaagagcgaaactctgtcaaaaaaaaaaaaaaaaaaaaaaaaaattgccagtttttagagttaagcgtttgaattatgattcctgacttctgttctttcaacatattgttactgcagaaagttgatagaactataaacaacaacatcatggggaaaacttttcatgagatagggttaattcttttaattggggtcaaagtctgtataagcttgttgacacctctcagattatttcagtggaatctgaatgtgatcagcaaaaccgcagaaataagtccactactgttctaagtaagttggctatttttgctcacactaaaaaataaaataaaattgaacaaaagagactagagggtttaaatgacaaaattctattttgtgcttttaaaaataagaaaaagcagcagcatagtttaaagacaacgagtcgcatctcgtttaattggctcaatagacttttcttctagttcattactattaagaagctaccccacacctggacagctcctaagagaatgtagcaatatgacaactcttcaataattttttattagaaatttttgcaacttataagtaagaataattgtattttaagatgtatgagtttataagactacctttttgaatcaataatttctagtaaggatttaaaagactgtcatgcaacttataagacgaggcttttaaaaatattaatcattatgctgattgaataagagcatgaatttatcagaagttagctgagttcaagactgtagaacttatctctctataatccccaccataaaggacagagtggattttataataccaagattatctgtcctgcctatttgaatatagaatgattggtccatatttgaatttgctgaggtcttcacaaaataattttaatcagcttgtctttgtagtaaggaacacctgtactttgcaacacagaattatgcatctctttattttctatttcatgctcaggtttccttcccacttcttccagaaagaccctgtagaaaaactcagaaagactattaaaatgtctacagtccacagcatttgctgatatcccttgtattcattcatctcgggaggctacttacatgtttattattttccaaataacttaatatgcacatattatatagcgattcttatattcaatatagctttcaaattctatgactgttaaaatgttattaatctgttttgaaggaaaactcagtatcaatatataaaataataaaaagctttccatttattgaagcaagttttatcctcattttaattttctaaaatttcctggcaagatatactgatatttaagaaatacacgcactctttattaaaaagctgaatttatcaacattagtgttttaacttttttctaattttttaaaataatgttgcccaacgttttgcagtcacgactcataaaaatgttttgtaaattactgtttagtatctctacctgctgaaatgataatatttatgaattaatatagctctttccaaaattaagtaataagattgaatatttaacaacaaacctggagaaaattattgattctaaccatagaacagtcatttgattaatttccaagcactattccttaaaaacaaagatgttctatcatttttcttttactctctcagatctcttttgaataacaggtggacttacttcatccagtcgcctttcagttcccagggccaagaggttattgtattctctttcaagaatctgccttgcctgttgacgtcaaattacagttaccatcaccgaaatcacattttattttaaaaatcaagtagcttatatttatctgataatgtattataaaccatactttatttatgggttttgaagtttttagccctccatgtctgttattagccattgtaaattttaactacaaaaaaaacagggcttttttttttttttctgtgaacagtagagagacagtcttgcataaacatctgaggtcaagaggctttggcctcacttcgttactatatttcaattgagtattttgtttaatctctgaaatatgtaaaaacaaaataaaaagtgaaacgagactgccaaatttttattgaatctatgtaggtagttctcaaacctggccaatgattatcatttgaggaaagttttgataataaagattcctatgccctatctcttgacaactgatgtcttaggactatgatgtgggttggaggttttattttttattcataaggaactatactgattcaaattattatccagttttgggaatcactgacatatccaatgctaagagtctgtataattcatacatgtaaatagaaatgactgcctctcagagaggcagagactgatggccatctgtcagggatttcatttagtggaatctggcattcaggtgggagactgggccacataacttcgaaatccctttcttgtttaattgtatgatttttttttttttttttttggctagaaatccactagcctgaaattaaaaccccagtgacatatttcaaacattgagttaactttcattaacaatcatgaatacacagccaatttttttctaaaagtttagtttatcattatataaaccagaacacattgagactacagcagaaagtgacttgcctgggtgttctgtgttggaatctgtaataataaagctaagctgctgtagtcaaagttttcatccagggctataagtgagccatgcacaccgctctcaagtatattatttgcatattctcgaagtccaattgcttgtatccagcgaataactcggtcattgctccacaccaacacgtctaggaaaagagatgcatcattttaggatgcattatttttctttcttttttttttttttttttttttttgagacggagactcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcgcattatttttcatagtagaaccactggctgaaatgagccatgggtatctggccaggtcacatttatgctgattcatccacactctaatccatctggctcccttcatttgtgtgtagttactgttttaataattaatcttttcgagtctctatttaaaaaagttgttatttttcagagtgtttgttatagctaaaatgacagcacttcagtcgcgtagaacacgatgtctgtgtttcttgttttcatactagagaactaggtgtctgtctgaagttcaatatttttaccatcagagggagacatttcttatttgtgtcttgatacacacctcttcagtaaacagcagacgagattgtaatactgtctttcatcagaagtgtttgttaaccactacctaaacattggcatatagactagaagattttttttcacctgaagtaatatataagaacagaacggtaaaataatataaggcatcaacagatggatacttaccttagtattatatttcaatgcatttttcccaatcacatgctaatgcaaaattcaagcactcagtcaaatgtcaaaaattgtttccactctattgaaagtagtattctattgaggaaaaaatttctttgatttttattttctaaaaataaaactttcagagaaaaatgccgtttctttttttttagataaaaacatcaaattatgttttatcatttattttcttcaatatcttcccattaaaagttgacagaatgctatataaaatgagtaaaatagtccgaaggactaaaattgtccatagaaaagaaagaattttaagaaacttaaggggatatgagaaaaaaattaaaacatttttactacccatagaaagggaaaggaaactataattactattaaagtaaaagtaagttttcctgtccattttttttctttctaatgaagtgcctagctctttcagacaaagtataaaaatctttcaggaaatattcttcaactttaactgttttaaatacctgtttcaataagcctttgaaaagcatgttctaaataattattttgatgagtctttgaaaatccttatttatcttattttatccatttataaccaacttagatgttcttgtgtataactttgaagcaatacagtgatagcacagacccacagaggtcccctcatgcaacttctcaggcaccattctcacctaacagtaaccaatattctgacttctttcattacagaatcgccttgcccgatttattttttttagcttttcatacataaaatcacccaatatgtacttttttgtctgcctttcattcaatatggaatttatctacgctttagcaaatagcagtggcgtgttcatgatcattgctatctagcatcccattgcatgattatgctgcaatgtgtccattctactgtagatggacatgtgagtagattccactttgggttattaagaatagtgttcctttgagggggaaagggtgggggatggcaagggataaaaaacaacacatcgggtacagggtacactgcttggttgatgagtggaccaaaatgtcagaaaaatcaccactaaagaacttgttcatgtaacctaacaccacctgttccccaaaaacctattgaaataaaaaaacaataaatagtgctgctttgaatattgttatacatggattttgttttgtatatttacatgttgcagtagaataaataacaaggaatagaattgttatgtgtttacttgttagcagatattgctaagcaaattccactctcacaatttaaccttgcattattaatgtctgaacatcttcatctttaccaatgctttgtatttctcatttttgttcttgttttgtcttgctttttttagtcattatggtaggtgtggtattatgggttgaattgtgttccccaaaattcttgtagaagccctaacttccagtacctaagaatgtaaccttacttggatatcaggtctttatagaaatgatcaattaaaatgagtcaatagagtgggcccaaattcaatgagactgttatcattcttgaatggcaaaatttggaaatagacatgcacacatggagagcattatgtgactatgaaggcagggatcgtggcgatgttcctacccgccaaagaacatcaaaaattgccagcaaatcaccagaagtcagggggcgaagcgaatagcagattcttttcagtagcaactgactctgctaacaccttggtctggaacttctagtgtgtaaaagtgtgagacaacacatttctgttgtttaagacacacaatctgtggtactttgatacagcagccctgacaaactaatacatggggtgtctcattgtagttttaatcagtaacacccattatgaactgaaaacgtctgctacttttaaggtttgtcagtttttactttccatattttaaatctacatattagatgtatactaatttgctatatctttccttctattatttgaaaatagccaacttatttctagtatgtttcctgccttaaagtttatattctgatattagaagaatcacagtagctttggttaatatttgcatgtatacctcatttactaataagttttctatgttcttatattgaaagtgtgtccattgtatacagcatatcattgttttttaatctgtccttaaattgaagtagttagttcttgcccatttaatattattactttgatatttgtgctgaattctaccatctatttgtcctatctgttctttgttctttttctctctttcttgccatttattgttttcttattttattctaccactccattagctttcttttttcttttattttttgagactcagtctcactcttgttgcccaggctggagtgcaatggcatgatctctgcttactgcaacctctgcctccaaggttcaagcgattctcctgcctcaccctcccaagtagctgggactacaggcatgcgccaccacacctggctaattttgtatttttgctagagatggggttttaccatgttagtcaggctggtctcatctcctgacctcaggtgatccacctgccttggtctgccaaagtgctgagattataggcatgagccaccatgcccggccctctattagctttttatatttacactttatattattattttagtagtgacacttaaagcttataatatgtgttcttattagagtctactataaattattccttttattattttctagataatgcaaagactttcaaataatttaatttcacttattcccttccttttgcattatagttatgtattttaattctatgtaaaatttaagtcctgcagatattatttttactattattatgacatttacccatacatttttcagttctcctccatcatgtgtgcatttttttattatctttatgatcatttccatctgcctgaatcacttattctaatatttcttttctatttgttttttttctggtgaaatagtctctcagattttgtttgtctgaaagtttattaattctctctttactattgatggacatacttcaaagtaagttagtttgattcagcattttaaggtaataattccattttcctctagcattatttagttgagcaatatcagttatattatgttgcgccattgaaattattgtggagtttactctggcagattctaagattttggggtgtgggaaatcatggttttcagtagctctattgtaatgtgtttagacgtgtttttatttccgcttttatttttaatctcacttggggtccatcgagaaccttgagtctgtggtttatcatttcaattattttctttttatgtctccaccagtatcttttcaaatattgcttctttcttattgtctcttacctcaccatgtccaatatgtctctagtgatgttttatatcattcgtcctttttgtttcttgtcatatgtgggctagatgttttcaagtgatcttttatttcactaaactctcttctactgttaaaccacctattgtgttctcaatttaagtctttatacttttcacttcttcaaatttccatttgattatttgttaaacatattgattccaactatattaaattctccattttctcacttatattccttacatattttttaataaacactgtcagggtcaactatggatatgtttcttttttctgattttatcatcgtggttttcctcattttggccattatctgacatgtctgaatttttcttttattggctctcacataatatgattgaaaaattgcagaggctctgaatgtcaacttcttcttaaaaggacttttatgtttttctgaagttataataagggcagatcaacttaattccaattaaagattgagataaatcaatgctagatttcaattttaacatttcaaaataaagcttaggaatctccttcactatagtaaccattttactacctatatgtgttctgtaatatgttctaaacctcaaatatacataataaaatttatttttaacattaatagacataataaatagcctgatctgtttaagtttaccctagtcctacggtgtgttttatcagagacctcaaattaaagcatatttggtggttatgacctttgattttttttactgtattatcatgagattacaacagttctctttctagatttattaccctttggcttcagctttctgttcaatttttagattataattccatccttcttggaagtccacaaatgtctctagaggagtattgtataaatggtcagtcttacttattttattattactatgttttacacattctttgctcctgaaggcccggcagttttggcacctctaaattccaatccccaccaccaccccactccgttccctgcttctctgttagatagaggaaaaacagaagagaatgacagttttactatttccttacatttttcttttttccaagatcataacctctcaagtcttgtccctcttaattggtttctactgttttcaaatagctctttattaccatttattgatttatctatcctttctatttcttcttagtggaagattggtctgacttaatatgctccaatctatcagaagtagaagttcttcaaattagttggtgtcctttctgtctgtgccaatccacagtactagcaaaacatttgtatatgaatctggaagctgaacatgtatcagcctcacatctctctacttaactccttttgtggatagaatgatctcatttcaaaagaaaggtcctagatctttctttggatttagataataaggaatatgagaggaatgcccacatcccacagtcttattattattagctgctccattcaaagcagaatgaatttctgcccgaagaaggacatttattgtcctcccctcagagttttgcctctttctccccgcccccccccaaaccggtctgcagcaaagcaaaggatttccttaatattctttactatataaggaaattttatattatacatgttaattgtctctctgagtcagttctgaagtgtagcttttcctccgagttttccttagcctattccattgaggttttcagacctcagaaaatgggatgtgagttggttagcatcacattttggctatataatcagctgctgctgatagttactgattcattctaacaactggttaccctacacttgaatcccaaaagctaggcaagtgcttgtgggtggcagcaacagttctccacttaattttattaaacacaccgttttttaaaaatgaacgtgacaatgctctcaataataaaaaataaatccagttttctttgcactagttggatttgtaaatagggagtatttggtttttttctagacttaggtttatattttgatagtctaagacatattatgtggtcgtgatatttctgcaaatatgtgcccatcaaaaattccatcgtcacacctgtagttaagagtgatcaaatatttaaactgatctgtttatgaggtaaagacaaataaagcattaattcaaacgtttcctcctcagaacaaaatacttcttttttttttcatttttaaagttagatctctttccataaatctgtttccaagcaatgtatgcactgactttaaaactgtgtagaaatcttcttgacctaaacaataaatggctagaaatcagtgttgactgcttcttagcaacaaattaaatgttagtaggttcttgatattcacatggtctcttcacttcagaaaactattcattaaggtcagggttaattcacacttcagataataagagacccctagtcactgttgagaattattcctgtaaatgtcaccagatcagtcataggaaacaagctatttatgatctcattcacagctatttatcagatagagttgtgtgtgatcataatgaatcatggcagtttttttttcctcagagctacactctaatcagcaattgccagatactaatataacatttggtatagggccaactgggtaattcctctcctttagatctatctatatgtgaaacatttcacgtggtgagctgaggcataataaaatctaattggataaaaatacttcagaaaggaaactacaaagtggtatcccatgggtaaaatctacctgtgtgctaagacattcattgtgtggtcacatgcaaacttccttctggggtccatctttggtccattaattcccaaatttcaattcaactgaacagcaatgcactgaaaacaacctgcagtttcctggggcccccaaataaagtgaagtcaaacaactcaattttgataatggaaaagcactttcgtgcttcgaagtaatgcatcaaatgaagtgttacaagaaatccattgtgagtctgtctactctccgatgagacgtacgtagaaaactatttttaaccaatcactttcacatgcattcaagcccgttccattagaactaatgtactttccaagacctgacaaagataaaagtaatttctgacattgtttatcaaaaatgtaaattatagaaacctaaaaaaaatcttaagaataaaacagcactaaacgttaatattggagaatgtaatatatactactttcttatctaaattaagccttaaaagaagtgaagatgaaaacagagattcatgcctacccttgaaccattaatgtaatgtagaaacacccattacatttgatgtaatgcttgcacatatcaactcttggataataggaaatgtaaatacaactaataagtattttaatatccaaaattttccttaaaagctttggttatattttccttaatattttcttctttttttttttttttcttgagacggagtcttgctctgtcacccaggctggagtgcagtgcagtggggcaatctcggctcactgcaagctctgcctccagggttcacgccattctcctgcctcagcctcccgagtagctgggactacaggcgcctgccaccacgcccggctaattttttgtatttttagtagaaacagggtttcaccatgttagccaggatggtcttgatctcctgacctcgtgatccgcccgcctcggcctcccaaagtgctgcgattacaggcgtgagccacagcacctggcctttttcttctttaaacaacaaaagtggattgattatttttagcaaaaaaaagcccacgtattatcttaagtgaaacaattcagaaacaaagtcaaatacctcatgctttcacttacaagtgggcaataaataatgtgtccaggtgaacacagagtatgcagtgatagtcattggagtctcagaagggtgggaggctgggagggtggcgaaagatgagaaattacttaatgggtacaatgtacatcattcaggggatgggtacactaaaacccagacttcaccaccacaaatatatccatgtaagaaaaccgcacttgaaccctttaaatttaaaacaaaaaaatacctttacctatatctttttccaatcatgtatttttttccttcaacaacaacaataataaaaatagaacggtctctaagaatagaatctaacatattcctctttgaaattattctttctcgggtatattaaggtacttctcttttgaaattattctttcttgggcatattaaggtacttctcttttgaaattatcctttgtcgggtatattaaggtacttctcaacatttagatgatttatttttaaatatagtattttttctaacaaacctgcaatatggagtgtcttttcttgttattcaaataaaacatttttctgcacataacagctgcagcaatttacactgttcctgataatattaccagctaaaattattaatgaactagtttggtttataggggaaaatccttatatcattcctgcataaaatcaccatataatttctttaactatacagtgttacaaaaataaaattgctggggcactggaataaaattaaaatgatataaaccaaagatgaactgccataaaaatgatataccatgtttctctgaatcatactgagaatgttccattaaaagtctgacaaaaatatctacatggagacatctttagtataagcagaatgtataattaataggttcacataaataagtctcaattcaaaaactcaagattactccccaaatgggatattcaccctataatatggagatacctgtttctgtattttaattagaaaagaatggaaaaaaaacagtaacaattctagccaaatacttatgctacttactgaccattgtaacacatataacattttaggttagtaaaagtgaaagctaaaaaccccagaataaaggcatttcatatgaaagaaagatatattaccttttatttcatgttggcttgcttcccgtcttctttctagttcttttctgtcataattcaacctctttaagcacataattccatattgtaaacttgttcttttttttttattaaaaaaaaaaaaacacagtgagtctaccttagcaggtggagaaagttttgtgattagccatagtcaacactatgcactgcttcttagggcaacaagttaataaattacatttgcagccaaatccttcagtattggagggaaatacatttataattattctaagcacaaaatgtttcgaagtaatagaaaaaaagttttcaaaataagaaaaaacagttttaaaatcatcatggattatattgttcatctatgtgtctttgtctttcatttagctattcctacattaggtgcaggcaaattaatattttattcacttgaaaagaatttaaagtccccattatggagacagtaaggaatttataagaaatggatactctcttcttaagctgatgagaaaaataacacaaaacataagtaagtgaggtaatagaagaccaaatactaaaatgagtagctcataactctaaatgatacagaagtatgtaagaagaaccagtcagcagatattgaaactgaatgaaaaggatatgtggaatgagcagaaaattgattgatccttaaagtatcaagtagcagagacaggttgactcaggaaaatggagcatcatgaacaaaagattgcagatggaaatttaaaggtgtggttagcgagacacacattccagggctgaaaacccatgctaggaagtaaggaggaatacaattatacatggagaaaagggcatattaaggaaagccttaaattgtgtttaagtatgaaatacatataattgatacagaattattggacaattttcggaggaggaagaggtgacaataaagttttctgtttggccaggcatggtggctcacgcctgtaatcacagcactttgggaggctgaggtgggtggatcacgtggtcaggagttcgagaccagcttggtcaatatggtgaaaccccgtctctactaaaagtacaaaaattagctggctgtggtggcacatgcctgtagtcccagctactcgggaggctgaggcagaagaatcgcttgagcccgggaggcggaggttgaagtagcccagatcgtgccaccgcactccaccctgggcaacagagtgagactccatctccaaaaaaaaaaaaaaagttttctgtttaaggaaaagtaatctcatagcaaaataggagatggagaaataagtaatcagagaagatagagaaatcaattcagggttcagttctgccaaaatagggacaacagccatgagcttgaaaggaaaatcgataaaccaggcatgttctgagagagaaaatgagaaggtttagtgacattatgtataaagatgcagaagatgtgataggaaaaaataatctgtagacttcaagagtaaagatcattgattatcagtgatactttacatgtttaggaatataagcaaatttagacatacacattggccagattacacttacttgctagatgcatttctaagccccgcattttaataaaaacaatgttgagtcaaatatttcagaatcagagaaaaatggaaagaaaattgcattaggcaggtgttgtgggttgaattgtgttccctaaaatttacgtgtggaagcgctaattctcagtacttcagaatgtgattgcatttggagatagtgcccttaaagaggtaattgagttaaatgaggccattaaggtgggccctaatccaaactgactggtgaccttattaaaaagagatttggacacttggtgacaacaggtatatatattcacagagaaaggattatttgaggacaccaagaggtgaccatcagcaagcccaggagagaggcctcagaagaaaccagacctgctgattccttgatcttgaacttctagcctccggaactgtgagaaaatgaattctgttgtttatgacacccatctgtggtcttttgctgtggcatccctagcaaactaattcagtgatatactagataatactgatataatcactatcacagatattgggcagcttgagattaaaccaatgcttcttggtcagtttctgccaagttttgatatagaatacaaaattatactatacagaggacatataatattatgaaaatgtctgtcagatggaaaactgtgccgaaaagaccataggatgcaatatacagtcaggtactacttgctttaagttggagattagcataacttaaaaatgaagcttgggcatttcccagaacaaacaaaaaccaagtcatttgagtattttttttaatttgatcattatagaaaacattttactaaagtaataaaacagtattaaaagtcaatctagtgaagaacggaaaaaccggaccccaaaaatctaatgcaaacgtgaaatatgaagccctaaacttcccgtgacagggagctcactcactacctcacaatgtatacactacaaggcagctgagagtggtacaaagttgtttcttctattaactagaagtcactcacctaggatctacatctgtgttaactaaaaaatgaggtgctcaacagagaaaaaataattcttctatcacataataatgatcttaaaacctaagaaaacttacttatttaaagtcttccttcatccaatttaaatgtatttaattacttcaactttaccactggacttctaccaccttataacaatttgatacccacaaataaatgcaatttctttttgttatgtcactgtatggtagcacttttgttgtctcagccaataaacacagtctaaacatgccttgtcaagccattaaccaaaatggagagtttcgtgctaaggataaattccttatctttttcacacaactttctgttaaattatggattctccatccagcactttaatgggttttttaaaaaacactgttatatttatctttaccacatttaattcaacagtgtcaacaactgcattaaaattcaaaatatcaccataagttggaagcaaaagccccaattatcctctatttatcctaattttatgtcatcaacatatctaatttttataccatcttcactccagccactgattaaatgttggacaggagagaagcaaatacagtctcccaagccaaaatcatctatggttatatttattaacttatcaccacaatcaactttatgtgaaaaaaacaaccaaaatccagctgacattgcttcacctaacataaacatagcatttatgatatggtattataacagacccctttttatctgctggatggtaaacaacttgaaaaaaagacattgccttttgttcaactgcatcctcacagttatctaacacagtattgtttttgttctgaaattaatatacaaataagcaaactcataaaaagacatagaaaaataaaaaaacacaaatatgtcttagaagaacaatttcttctcaaaattttccctagaatgttcctaaattataaaatttataaccacatatttgtgtagagttgaaactatgaatttgtttattcttcctaattttctaatataaacacatataactataaaattaccaacatggaattttcaaagaatctcacaaaaaaatagatgtatgctctatgaggagaattttgtacacatatatttccataaactttgggcacataatatgcacatagctctaaattagaaagtccctgcaatttgctggatgaaaacatttttccaagtagatgtatacaaacgatgtttcaaatgacatatattttctgtcttctagacgtccatttttgttttactaaagtataggtaatatattgtttcattttaattattctttggggaaaaaaaagaaaaaacacctaccgatggaaactatccaccatttttaaatggacacggagatctttttttgttaggtgatctaacattcttgcatctaccaagcattccataaagtaacttctgtactgaggtaaccccaagctgggaagccattcatttccaatccactcatgattcatatctccataagccagggtctgtagaaaaaccggacactagaattgttttatagcagtcaagtttcttaaccaatcagataagatggtaattggataatattacctattattataactgatatttaattactatgatatgtggaaacaaagcaaaaataatattcagatagcatttgattcgatttggtataaaatggaactctgcatacatttattaaagcatctgcctattgaaaatgattggctatttactttgtattctcaaaaggaattacattttgtccaagtatgtattttattaataaagaaattattatacaaactctgagctttaagattctgtctttaaattgataggtttgttttatttgtatctgtcatttccctcttgtcaatgcacttattgccatttcccacttatcaatgccactactaccattgctatattgtaatggcaaatgttgatgtgaaatgggaacctcagtaaacagagaaaggaataaatgttttggagagacagaattttgaagctttttatggacattgttgttacttagcaaagcaggtcgtcagctttccaaaaaatcattggaaagaatcagtcttttctagaaattaatcaagatagactctaaaagaagcaggacaggatcaaaaactaagacagataacctaattctttaatataacaaacaaactattcttaccaatactgttcaaaacagctaaaatgaaaacccaaatcaaccattaccactaaaccaatattttaaaagaactattactctctattatttttacagaattcccatttagttccttatcatgccctaatttctcaattctaatatgcatttctagggaaaatctaactgttcctcttcttttgtgtgttctcaagaacaatgaaatttttatcaaaatcaaaatcaaatacaatcctactgtgtgtttaaatacaggtcctaatgtaactaccaaattttttcttatattgaaaggtttcaatcagattgaatataacacaaattttctcttttggtcatccaaaatgtggaaatgtagaaaaaatgcacagcttccttgcaaaagtatatgtctgttccaagtatagacacctgtctcatacaaacatctcaataaatgctagtgactctgtggtctgcaacgccaacacttgctcctccaacctctcttcatacactttgcattatatctgaaggcatgtgcaactccaaataagtcttttctttctttttgttccccctttagatccaacttgaatgcttcctgattaaatatatacaggagtgatttcagaggaatttaagttttggatcattcttttgagaaagaaagaaaagtacccttttaaaagaggtaaggtatgaaacgtcaatcatcttattttaaaaatatggtaacttaaaaagacatataaagtattaaacataatctacatttacctatacacatcagcctaatattgagctaagtgaaggtttacaatattatgacttatgacagtttcttgatttatattctcattgcctactaaatgatattaagggtcttaaagcatatgaatctcctacctgggcccagcttccttcctcagattctttctgtgttagcagcaggaaatgattaataaagcaggtaaatataaattaatttcaaatcaatacagtaaaatttttctagcagaagcaaaattgttatacaaaatattttgtataacaggtagaataaacacacagattcatagacccacagtgatcaattttgcagttcaaaggcaattaggcagcaactacatcattttcaattaattctaatttaaatgttaaattcataattttgtgaacatttgatttggtcattacaaacctttttttaattcttaaatgagtgtaatttttaaaatgtaatgtgctataataaaaacttctgatgacaaatatatatatgtatatatgatagagaaatcttatacaaagtaaattagtgaagtgaaaaaactgtatccctccaacaaagctttgtgataatcaaatcgatttcaacaacagccaacaaaacaaaacaagacaaaaaccaagtacaacaaaactaaactaaaaatgaaattagtacatgacattggtgtttttatccttaacaaacttgtagataatcaattttcaaataaggataacactgaaaagacattaaattaaaaagaagttgataaagataaaatatatgatatgcccaactttgttactttacatgaaaaaatgatttttatagcattttatttttaaaagtgacaaagagtccccaagaaattctttaaaattgtgcttttcagtaccaaattaacataacacttttttggttttttgggggtttttttggtcaagcttgtatctaagatggtaaagcacaagaaaccacatgatcatattaaaaatgaatattcaatctaatcttttctattaccaatttaatttggtttagaaacatgttacctgtgaatatgtccaatactaaatatttgttacaaaaacttccaatgttgcaacatgaatactatttattactttcttccttattgtttgtgtactataagctcttatgatattagccacaatctaacactatttcattaaaaaatttcaagagagtgcagtaaaagaaaactgtaaaaaatgttagttatcattgcatgtaactataaaaacacaccctattactctggtctattgtaaacagattagtttcctcatccaaagagcagcaaagtcactttccttcaggttcaacaaagccattaagactaaccgtttttgctggagctgcaagattttccatttcttcatgagtcacccaaacgttgcctgaaggctagtgaggaggcccagagggaagcagaggaatccatgggaggcaagcagtggtaaagaagaaaggcagcacctctgtgagttaacagcaacacagcaataccacagtgcccttgcccctaccgtgtgcatgaaagagacagcatggctggtttgctcagagctccctgtttcttctactcaaaaagattaactagaaagaggcattctgtgaagctcttggggatgtagatttaaaatgacatttctgcaattattaatcagaaaaagagcatcatcaaaatttgcatttcaatggtatgtggctatcagatcaatttttgtaataacggtgaactgattaaatttgaactgtagaataatgtaattttaattttttactcagaaaacaatggcacatgcactttgttgtgttattatcaaaatttccttcacataattttgattctcgatatcctttgaaggaaaaaaaatggttgtcaatataaagcgggaagcattatcgtaacttatctggaaaccagcatcagcttttcccaaaagattccttttactgtgtgtgattcagtaaatagtaagtgtccctgaattcttgcagctgagaaagaagtgaaatgctatttttaatttaataaaatgtattttttagccacactaataactgtcaaattataaaatccatatatttcctaattctccaccagtatctgataccattatagagaagaacatagtgtaaaataattttttttctctagcaggcaatattctattataaagtcccatttgctttctaaataaaacaccccttggtattagttctatacacttaataacgtacagtttcgaaaccaaagtccacttagtaacatacagatcaggcatatcattgaaggtattggcccctggaaaccacttgccatcaaattccatcatttctttatgaacattgcaaggttttccaagcacatcaatgaaatttacatcctatatattatctgctacttgttttggggagggtccaatctttaaagaattggtgtagcaaagttgttacccaaacattacaagtcatcaccataattcactttgggtttttctgccattcacctagtaccataacttttcctgtattaaaaacaaatgtaactacatataaattgatgagtataatttgatgtaagtgaaatcttatatatgtatatacatacatatatacagtcatgcactacataccgacattgtagtcaagaatggggtgcatgcacaacaaatggtctcatatgattataatggagctgaaaagttcctgtcacctagtgatatcagagccattataccatcgtagtgcaatgcattattcacatgtttgtggtaatgctagtgtaaacaaacctattgcactgccagtcgtctaaaagtatagcacgtgcaactatgtgcagcccataacccttgataatcatcattaatgactgggttattggtttatgtatttaccacaccatgatttttaaatcattattttacagtgtactccctctacttttgttttttaaagagttaactgtaaaatagccccaagtaggttccttgggaggcatctcaaaagaaggcattgatatcctaggagatgacagctccatgtgtgttactgccccaatgacttttcagtggaacagaatatggagatgaaagacagtgatactgatggtcccgatcctgtgtaggcctatagtgatttttgtgtttgtgtcttagtttgtaacgaaaaagcttaaagaggggaaaaaataatgaaatagcagaaagcttataggacaaggatataaagaaagatattaattttgttcagctgtacaatgtatttgtgttttaagctaagtattattttaaaaagagtcaaaagttaacaaaaaaaaagatttataaattacaaatgttaccataagctaaggctaatttattactgaggaaataaaaaggtttttttatgaattgtgtgtagtataaagtatagtgtttataaagtctacagtagtatatagtaatgtcctaggccttcgtattcactaagtgccctattcacgtgtaccattttttatcttttatactatatttttactgtaccttttctatgtttagacatatttggatacacaaatacttaccacagtgttacatttgcctacagtattcagcttagtatcatgctgtgcaggtttgtaccctggagcaataagttataccacatagcctaggtgtgcagtagtctataccatttaggtttatgtaagtatgctctatggtactctcaaaacgaagaaattgtttcatgactcatttctcagaacatatatctgcattaagtgatatttgattgtatatatacttaagtaacaaatggaaatgggtggtaaagattcataattataagcaaattcgaggcacataaaaattccacaggctagacatcaaatatatgtatagaatttattttcttctactgttttggaatttagagtacagatgatgttttttctataagataaatctgtgtacacctattaaataaatttagaatataaaagtcatttatgtccttaaaagtcccttccttgtattccctgcttctaacaatgatgctcattataaacagaaagttgcatatgagtatataaatcattacattacttggaataaattgtttttattgactttaggaggagagtgctgtgctgaaaagtactttacatgcatctgtcacattccctttacactgagttatcgtggtgctttcttgagtgggtatactgttggttcaaagtgagtttcagcaatgattacctgagaagaaattcatttaagccaatcttaaatggcttaagcttgcagaacagtgtaaaatcaattttacactgatttgtgtagcttctgctttgaatcgtaatccaaataatgaagatctcattacttctttaagaaactacctgtattaattatctcatactagaatagatacatgcatagtatctttcacagattatctttaagtctgtgtctgccagtctgtcaccatattctgggatgtggaacatgctggaagctatggttttatctgtttcattcctcacaaaataagcatatacccaggacaattttctgaagtatgactggcaaactttcagaagttgtatgttagttgtttctgtttgatatgcagttttacttgtgaagaccactgccagccctatagtcttgtaaaaagccgacagaaatagtttctacacaacctagtcaagtagacattaactgaagttttaacaagtttattttataggcaagctcatatgtagtaagtcaattattcaatcagattgctctctctccaccaccactttaggggatggaacttgcatctaagtacattgtgacggagtaatttacagcatgagagtttcagagcaaagcatccctacaagatagctagattgggaaactgagcaatcaaagggcataaagatatgagtaccttgggattgaggatacagtacaaaaagtaggttggaaaagcataagaaacaaatattgtataacttggttgtggttctctgagatccccttaaaattatctactcactgcccttggtagtctgtgctgcaatctcccccaaaaatgtgcgagctagaaaatgcaaaccaatagtcatttttttgtggctaatatcatctgagtctaacatgaaatttataaaatttcaattatattatcaaattagaatcaaggggcttgagttatacagtagcacttactaatgactactctaggacatttcctaagcctgtctaaatttcaggttctgcacttcttaagtgggactaaaagtgcatgctccagaatagaaagaaacactaaaaagtttacattatgatacaacatgttcttatacagggctgggactaggatgaggcacatgaggtcctgggaggctataatttaaggaaacattcactttcagggttgatatctgacaatgagagcctctttaaattttatgcttgagattatcttgcttgtctccccttagtacccatggaatagaactttgagaaagtatcaagggagaaggagaaggaaatttctaaaaaatgatcagaattaaagaacttacctaatgaaatcattctggaaagagttaagacagaaaaataaatattacaatgaacttaagaaataacttgtgaaaattaatcaggtgaaaataatgagtagtcttgctgtcagagatacagtataagtaaagcagccagacctcagaataatcctaaatcttacctagttaaagtaacttttgttactacctaggtcatttaaagtgttttttactttgtaatggaattacaaagtagtaacttgaaattacttttcacattcaaatggcctggatccacatttctcccttatctgaatttttgtctctcattataagataaatccttctcattataataagaatgatatttacacctcactctcttttcaataaaggttaaggtttataaaggcaattataccacaccctcttttcaataaaggttggggcttatgaggtaagtaataatgaaaagaggaatcaaacagactaaaagaatgctataaaaagaaggaaaactgatagagtgcaggaagcagaagcaggagaatgtgcttgttaggagaaaacccacataggagtatgaccttaggtgagtcagtttacttctttacattagttttgcccatttgtgaaacagctataataaaagtacctttctcatagctgtagttgtgagagtcaaatgggctattacatgtaaagcgcttagaacagtccctgacagtgagcattctgctgatgttggctactactgtaattatattagatattctgttaggtagtctccattcaagcaaatctttaattcaagaaatactctgtaggtctctgtattacactgagctgactaatgcctatcttacaccttacatttatgtttaatcttgttgaattatatggttatcaaaaatcactttgtttaaaacttatttatttccactgcacttgcttttaaaatgtttaattcatcaacttaaataaatgttacataaagcaaaatataaaacaaatttggctcctatataaacactaagttgaattagttggaaaaaccagagataggcaaatcttgaatgaaacacactatcaataaaatacaattttgtcaaagtctggggaaggcattgtaaatgtccagaaggattcctcattcaaatggctttttgagttatcttgaagtcgtcactttaaaaagaaacaccaactagagaaattaaacatgtttccagataagattatctaaaaggataatgtggaactccagacattggaaacatacacaaaaatagttttaggtgctccatctaaatttgcaattctttaacatttctgtaatttttacctgagataaagtattcaaagaatgcacttatttttgttacatccttcttcaaccaaatttcaattaactggtatctccatctctatcctactaggtaagagactttctgtagtaatagtagcttggagaaaagaaacagaaagctggaaatttagggctggctcaaggtaatcatatatgtgacatttaaattttcctttttgatggtccagcccattatatctaggcaggaaaggaggctgaatcaaataaagtagtagaataaataaataaataaaagttaaaaataaaaaagccccgaagcccaagtaccttgtctttttctcctcagaacttcagttaataaacacgaaatacctggctgaggaacccaagcccaaacctcagtgtgcaaaataacttgtataatctaaacaaactgtagtgttcttgaagacatgatagaataactttgttaaaaaaaaaaaatctgcctttgtgttttgtaagtgtgaattctaatacataatgttaggttatgactttatgtagtggattcattaatagtgatttatgtggaattttcatttgcaatgcaaattgtattggaaatatattagaaatgagtaaatgctaccatgtagagtgagtagaaggaagaggaaacatttagtagatacttttaaagcctagagacacaacttaacttgtctcatagaatttgcatcagtatctggcaagaggtacatatattccgtgaatacagagctattacacattagtaaaaagatatatattcctataataataaagataagttgggaaggttatgaatagaaaattaatataaataccagattaataagaatataaaaatttgcacatttagtagtgatttttaaaatgtaaattaagcaaggagataaccaatgttgacaaagggagaaaaaatagcaacacaacacaatttaacaattaaagtttaaaagtattaagaatatgcattccgtatacacaaatatagcaatggaaataaccacagtttatgcaacaacataattacaagcacatattttacacacaacaacaaattgtgttacacaaaacaaagaaaatgtccaatactaggaatttgattaaataacttatcacatttctacaaaggacatattcaataactaaaagtgatgttgcagttgcatatttaataaaatgaagaaaatgcttacactacattactaaatttacaaaaaagtacaaattaatatattatgtgaaataatccatttatataaaaagataatgaaaaaagaatgacaagatcttcatcaaatgttttcaatagtgaaaaaattaacattgattatctctaaaatcagtattttttaatgtttttaaattattttgttgtcatctttgtatttttctgtattttacaaatgttatacaggatcatgtattagttcaataaacatataaaacttaaatgctataaacaatatattttttatgtttcaaatgttcatttttgtctgaagccttatccagcttgtagtgatttctcctttcttgaagctccatcacacttcacttctattgcacattttggagttaatctatataatcctgtactaaatctaccagtcaacatgcttattttccttagtagagtttccctttctgatctcaaggccacacgtttcttatacttcagcagagtatatgaaatatgtgggtagagtgatctatacaatgattattttaaggtgaatatttacataatatctaaaatttgccaggcactattgctaaggcttggggttgatggaaacctgatgctatctttatttcgtctagtgtgagataaatgaagaaaagaagaactgtaaaatgttgtttataagtacatggagtggtaactcaggaaggaaaccaaacccaggctttgggggctcagcaaaagcttttcagaggaaatatgtaaaggaatcgataaatgaataatgaattggagaaaatatgatgactttgaagtaggatgaaagttttgggcaaagggaagaccaactacaaaagctcataactgaccaaaaggaaagatgtttgaaaaactgaaagtagttcctgacctgggaaataaagccttcgaggtgaactgaggctagatcataaagctttctttacttctccccattctttaaacaattgaatgttaattaatatggtataatttaaattccttcaggttggttaaatagttttagaaaaatggttttaaaattccctattgttcattaagaaatgaattacactggtaaataaaaataataaaatgtatcatatttttcatctggaagttgggacttcaaatttatttttgcaagattcataatgtttaataattttgtttgcatttgctcttgggaggaaaatgtggatataaactatttatgatgcttctctctcagctggaaattactcagcaaactcttcatcagacttaaattaaatttacaataactattttaatggtcttctcagtttcttattttaaatatacaggtggctcttgaacaacacaggtttgaactgcatcattccacttatacacagactttcttctgccactgccactcctgagacaacatgaccaatctctccccttcctcctcctcagcgtactttcaacataaagacgacgaggataaaggcatttatgatgaactacttccacataatgaatagtaaatataatttctcttccctatgattttcttaataatattttcttttctctagcttactttattgtacgaatggagcatatatgtgtacatataaaacacataatacatgcttatcaactatttgtgttatcagtaaggcttccagtcaacagtaggctcttagtagttaagtcttgggagagccaaaaattctagctgattttttgactgtgtgtggggggtcagcacccttaactcctatcttattcaaggggctattgtattctaaattgtcttttagcttgagtcataatccaggtatagtgaaaaacatttgtgtctatttaaaaataatataggtaagaattttaaaaattatatatttttcctacatgtcatttaggaagaacttaaaatggagttatgtaagaattatataagccttttaaatttgaccttttatttctggcattagaatctagtatactgggaaggaaaatgtgtaaatagaaatgaaacaaactattcacaactgtttaagatcatgtataaaaaagttatacttgttacttttctgcctgaaaactgcaataaagtaataagactttttaatattttacctattgctaaaatttatctcattctcccatattttattatgctatataagatatgagatttgggaaatctagtaattatcagaaataatatactttataaacaaaatatataatttaggaatggaataaacaaataattaaatactatttgggagtttttgggaatttgtcgtcatgcatgccttttttgtcacattttgttcttttctaggattaggataggtaaaaaattatgagatgactaggaatttataactgaaaaacaaacagactttgaaagaaaaagatattccagatattccatttggtatctgtaaaacgtcaaactcacataatttcataattacagaaacttcttaagaaatagtgagttacaaaagaacacatacaagtgtccaacaaacatataaaaaagctcaatatcactaatcatcagatatatgcaattaaaaccaagtgagataccatcccacctcagtcagaatggctattactaaaaagttaagaaaaaaaaaagatgtcggcaagggcacagagaaaagggaacacttatacactgttggtgggaatgtaaattaatacaacctctatggaagacagtatggagatttctcaaagaactaaaaatagaatgagcattcaactaagtaatctcgctacttagtacctacccaaaggaaaagcaattgttatatcaaaataattcctgcactcatgtctttatcacaacattaatcataatagcaaaatcatggaatgaatctaagtgtccatcagtggatgattggataaataaaatgtatatacacaccatggaatactatgcagtcataaaaaagaataaactaatgtcttttgtagcaacataaatggaactggagaccattatcccaagtgaaataacttggaaacaaaaaaaaatcaaatacaacatgtcctcacttgtaagtgagagctaaacaatgggtacatgtggacaggtagaaggaaataacagacattggagactccaaaagggaagaggttggtagggatgaggtttgaaaaattacccattgggtacaacgttcactatttgggtgatgggcacactggaagccccaaaatctccattacataatatacccatgtaacgaactttcacatgtaccccctgaatctataaaaataaaaaatattaaaactaaaaaatgtagtcacttaagccttgcatctttagtaatcactaatgcttatatcttatcttctgagaaattacctgagggaaagagaaaggaaggaaggaagaagggaaggaaggaaggaaggtaggtaggaaggaaggaaggaaggaaggaaggaaggaaggaaggaaggaaggaaagaaggaaggaagggagggaggaagggagggaggaacaaaggaacgaaggaaggaaggaattgaaaaaagagtaagctcagggtcttgtcgcttgggagaaaaatctaaacttcagatgctagctcaaaagtctgctatgctagctttcacgtctgatatgaatcatagttcctcatttgaaaacctattaaaagtagcagcaaggttaataaagagcaagcttaatctcttgagaataattcaagctgacattgaaatgtgtgctgtcacaattttgctctgtagacttagacacacggctatttgcctagcactgaggaaggggaggagcagaaactgactcacagttcgagatgttggaggagctgaaggacttgttagggaaaccatctcctggattgctaatcgaagttttaagcgatgcagtggattgctgattccaatttctctctggatctcagtgtcagataaagcagacatgatggcaccactcttcacgttggctcggcaggctgccacgtaccacgcaggcattcccaaccaaagctgttagataggaaaaaatacactaacaaattataataatagttatcattttagtgtctcatatgctaggaattattttatgtatcttacatacatgacctcaccccacgagataaaatgttatcattattttccctagaggacatagatgcacaaagaaattaaatgatgtatttaaaaacaccagggaggcagggatagaaacaagatttgaaattgagacatgctagctccagagactctattttaactaattcatattactagtggtaaaagtaatggctgcatggcaccaagttcccctttgtatgtagggaccagaacggctacaagccacatttgataagggactcaattaatgtttgcttaatgagtggcttcaatttataatgcttctttggaattctgagtgaagagaaattctgtcacagaacgagacagctgtgccacatccagccatgtgatttcgatcaaagcatgcagtgtagctaagccacatttccacctaccttcctacaccatgtgaaagatgtgtgaacttaattagatgctatatatgaaaatgccttttagagagtgaaatgatgtgctaagaaagaagttaaaactcaaatcattgaaaaactaaagaaagcaacaaaattaataatgcatcagaaattagagattttaagactgggcacagtggctcatgcctgtaatctcagcactttgggaggccgaggtggaaggatcacatgaggtcaggagttcgagaccagcctggccaacttggtgaaacatcataatactaaaaatacaaaaattagctgagcatgatggcgagtgcctataactccagctactcgggaggctgaggcaggagaatcacttgaaactgagcagcagaggttgcagtgagctgagatcaggcctttagactccaggctggggacagaatgagactctgcctcaaaacgaaacaaaagaaaacaacaacaaaaaatgaggccaggcgcggtggctcacgcctgtaatcctagcactttgggaggctgagatgactggattgcctgagcttaggagttcaagaccagcctgggcaacatggtgaaactctgtctctactaaaactaaaacaaacaaacaaaaaaatcagccaggcgtggtggcagatgcctgtaattccagctacgggggaggctgaggcacgagaattgcttaaacccgggaggcagaggttgcagtgagctgagactgtgccactgcaatccagcctaggcaacaaagtgaaactctgtctcaaaaaagaaaagaaattagatattttgatttttcaactttgctgtgagactcttgaaagacaattaaaccagcagtgctatttacacagcacaggtctcgtgcacatctcaagcactgggtgaatgccaatcacgggcattatatttcagcacctgaataacatcacttaaaacaggaatattctcccattttccctccatcattagttatgagtaagaagtagaaaacacaacaaaaaattagcagcttacatatttgtttttgaatgtccaaaagattgactgatttttttttctatttgttgaaataaacagattgaacaaaggagagaattgtgagagtgagaaaaagtgagacaaagaagaaaaactataaatcagcaaaatacagtgccaagagctctggaccacaaatcagaagacctgagccctaattcctttccagtcattggtgagtcatgtaacccatctaaacctcagccatattttcctcatttgtaaaatgaaggaatcaagcttgattatttctctctacctcctgatatccgttcccttctataatctccttcttttgggggtaggattggcccagtgatttatttctaataaatagctgatgataaaagtgatgggatgtcactttccagtttaggcaataaaatgactgtggtttcattcctgctagtcccctcccgctgtctctttccctctgagctctcactctggagtaagtcagatctcaggagccctgtggagagtcccatatgacaaggaactaatgtttctggccaacagccagcaggaaactgaatcatgaccctgaccatatgaatgagcatggaagtggattctccccaagtctagccttgagatgactgctgccctggctgataccttgattgcagccctgtgagagactctgagcagaggccatcacaaagctattcccagactcctgacccatagaagtcatgagatcataaatgccaaatttgggggtaatttgtaaacagcaatagctaaccagtataaacatccttttagttgaaaaattctacaatattaaaagactatttgtctcttttgaaaaaaaaaatgccaacaacgaaactctttgagtcagtgtggactgggttgtgatagagataagagaaaagaaggggaagatctaagtacaatgtgtgactgtacagattatgctttcttccagcaggttaggcacaaataattgaccttgacaggtacattatatatgacagaagatagtacttgactatttagtttataaactcaaactgttcaaaataactaaacatctaaatatgtcttctttggaccctaatgatttttttacctttgtcttctaagatatttggatttccacactagttaacatcacccaaatgcctgccaatacattgttaccaatgtcatccataattagaccttaaagagtctttgatgcggataaatggcatgtgaagcatggaattctcgcctacacaaaattcttaacaggctgtgcactcaaggaggaacgaaaggagatgaagttaaagtttcattcattggatcactcagctcattcatcttgtttattccattttataatttaagttgcattaggaatcataggcaatttctgtgtactcagaataggtttaattagcacaaacttcactgtctgtcatctcctatcaccttaatgtcagtaaatctgtttcttttttctttttatctgaaggatttgttcgtcgcttgccaaaatagcagcgaactctctgtcaaactgcaactcattttatcggagcaaaaactgaacaaagaactgctatcatttctgaggtgtgatttcttaagcattttgtcttgtgattgattttttaaatatagtaattttaaagacacggttgaaagaagcagctgatcgctaatatctgatggctaatatgctaaatttccctgtctgatgtgaaagaataaagtaaaagcaaaatacaggcatttttcattcagtgcaagaaaaaatacaaagcgtgtttctagatctatctaagtctatttttaaaactaaaatgggctttaatgtttctttattatttatttacttagctctggctataataaaatgaagacggataattttataatccaagaccatttaaaacaacatgtataattacctctggcaggcaaggaaagcctggattcttctttgccctgacacaggcatatcctagcagctactagcagctcacatagagaactgaatagaaggggcagtgaacagtactgttaagtgacatgaaacagcccttcgtagtcaaatatgtagttccgtcaatgtcaaggtcagtttctgctgcctcctacactgttcagatattcccttatttttccagaacactatgttgtacaggaaatgctgaaaatagttcttcttttattgtagcattcagtttggacacagaagggaataaggtgtaagtcttctgtttaatcccaagtgtctaaacctagctggtccataggctttagagaactaggttcaggaactaaattacaggcaaaggaatgtctctctgtacatctaggtgatcttactaccttggattacagaagtgttgaatatggagagggtcttctctgtaacctgctaatgaggaagggccctggcctaatggatgggaatggatgttctcttgcaacaataaaattttgtttcttctcttgctctagaaatgaaaagggtgtgatttagagacacttccttttatcccactgcatgatttcttctactacgatcacaaaaaagtgtcagcataaaatcataaatttattccctagtaagcaaatagtcccttatgagcaattccagactaaggggatgctgtgatttcagaaacttgccgttacctgtctcaaaaaaattatcaacttagtagtgattgattcaagggcctcctagtttcattctcttacctctagccatgcgaccacagttggcccatcccactgggcaaaaggtaatccctttctccgagcttcttcaagaagttcatgcctgaagtatatagcaaagattattaggcaggtatatggaaaaatatggctgtgattatttttaatgataatattttaaaataaccaatcatcctttacaagattttttatgatacaatatagaataacagaattccttattcctttgagtaacacacacacatcatccattgattttattacgaatgaagcattgacatagaaaagtaattttccccaacatttattcatgaaaattagaacattaagtgctaatggaattagaagtggaattatattaccagcaaatatcttatccctttaatgagaaaatggcccaaatgttcatattcaagtatgcattatgggatctaaatgtggcttccaccatctgccctgccctctttgccttactatctccatggcaaagaaaatgcttatatagagaggcagaagataaatttggtccttttagtcacattctagtgatgtggttgattttagtatgccctgtgggtccagggatctatcttaggagttagttatttgtctagactataaaactacatctcacttggagaaaactccaaggtaaattgatttctaacactcgaaagcaatgtaaggtatcaaattcaatggtacacttgcttttatctataatcactactgttttaatgaaattaaaatatcttaataacaacaaatggttgttttgataacaaaagatgcaaaagaactctgaaaaatgcatctataatttcactgaccctcttactgatttttagaattgacatccacttacaaagccaatttgagatcactcattgttaagatagtagctatgtgctttcactgaaattcaaattgatatatacttggccaggaatatattggaaaatacattctctttactttagtatgccttgatcttacacatagatgataaaaacatggtataataattgctttattttgaatgcgtatgttttatgcttaggaatatttcatgaaaatcatttatgaactcccaaatggataatttgattattttctactattaatcaattagttactgtggtagactatattaatacattaagatatataatgaataaaatgcctttcaacacagagttttctgtgtttgtaatagatgcaaccaaaaattcattaaaaaaggtgcaaaatacaaatttaagttatagtggctgaagagacataaatcaactgctgtttcatttgaggggatagaagtgttaagttctgcatgtaagctattcagcacctgggaaagggaacagcgatactcgtgctctgaatctaaaaaagtagaggcacttcttcacctggcttgctctatcatcctccattccctcaggtctcccagtgacattcctttagtgaaaaccagtttcaaatagcttagcctcactgtgacagatatatatatatagaaatggattgaaggatcaaaaacaaataacctattaggtacttattgaacacctgttgtggactgagacttgtgtttggtgtggaaaatagatatgggtctaatttcccaggatatcctgttagatggacaaaacaaacacatgaaactgtctgaaaatacaatacaatacaatataatacaatacattacacaaacagctgctaacgtgaaaacttggtgatgtaccttgtgaagtatgtcattttagaaaaggggttaatagccattgaaggtgttgtgaaggcattgtggcaatggagctggcttcgaagggcaggtaggaaagaggtggggatggcattccaagcaggagaagcactaatggggaggtatggaacttaacatgaaatacgtggaagaaaatttagggtaggccttcacagagttaatgcatgttgtaagagttttaatgttacatccaatagggaaagcgacacttctagttatgtcataggtttgtgacattaaaagggaagaaataaatttacatttacaattagtttttgcttcacatagtaaaaaagcaagtaaatatgcactaataacctaaggagcacgtaacattttcagaagtgtattctatgagttgtacaaaagctatttttaaatattagaacgctttcattttgaaacttctgactagttccctaataaaaatcccactagaaaggccagagtgatccttttgagtctgatcatgtaacttttctgttcataactctccaatcacttcctgtctcactggaaataaaagccaaaacagctgctacaatctatcgtacccgcgccatctctctgactaaactcccatctcagtcagcaacactggcctccttgctgttctttggaaacaacccagacctcttttctgtctcaggatcttggcagctcacctggaatgctcttcccctctatctctacatggctaactctctcagctactttaaatctttactcaaatgtcacctgttctctgaatgtctcctcccttactccctgaaaactccaataaggaatttcttatccccattgtttgctttatttttctccaaggtattgcccttctaacatagtatattatttactcctcattctgtcatctgccaataaaatgtaagctcagggaggatctgtgttttcatatgctctgttcagagatgaatttgaagtctagaacaagatcaggcacagaagaggtgctaaataaatacgtgtaaatgttaaacaaaatgccaatcagtgtttatatttaggtgcttcttgtttcagtaaattgtgtcctataatgttttgtttttgtagtccaaatagctttttctattttaccttataaccatgtacaacattttgtattttaaagaacaaatttttttcttgcatcttacctcctcttgagcttttatttcccactttctcacaatagtactgattctagctgatcccaagagtctgatctatttgggattcctggtgagaatttggttaagaggcaacccaatgtgctcaaatagttctgttctatgaacagaagtattgataacacaattgtttgggaaattattgagcaatctggccactgaaaaagttttattttcttggtttttgttttgtttaaatcacaaactctaataacaggatgactttagtaatagcagtctaagaaaatgagataagggagctcaaatcctttggtttccaacagttagggcaaaatctctagcatctgtcttagggctgacatacttgagactgtggaaaaacggatcagatgggagggatggctaggttttacaccaggactgtgtgctacatgatggtaactccagatgtgcttttccttttgagagaagtaacaattatttaaaaaagaacagcattgaaatttacaaagcaatattgccttgcattattatttttaattataaaataatcggcaccatacaaaatttataaaaggcatatatctaggcatgttggtttgagagacaagcaatgctagaaaaataaagcaatgtgggcaatgctataatacttggaaataactgaatttaatacatgatgatatgctaatagattattaagggtagcactaattacataagggcatgcttattctcatcaagttttggagttactgtcagaaaaatagtgatctgaactgtataagaaatcctaaatgacaaactgatttggcacaaagaagtcttttggatatactgctgttctccgttcaacctgtcaatgtatgtaaagggatttagtctggaatggattttctttgtagccagaattcaactttttttaaaggtcaagtgacagttcatccagaaaaagaatgtgatcacttaccccagtacaaatttaactatgaaaattactctctttccctgttggcctgaagaataattttagtgtgtttttaaaaataatttcagtcaatcaaatatttgaccatcttttcccaaaggatcacccgtacatcactaaatttcggggcatacatttcaggtttaagattcagaatagattttagagggcatcagctgtacttccttttagaggaagtgtcaggcatggaggtgttatcacttgggtcaaaacacaaacaagaaaagtactaattgcaagaaacagttattttgagacagtacaacttctgaatcattgtgcattttcaagaaacactcttcaataaagaatgctgttagtatcttccataggcctcaggttctcctattattgatatcaataagttactgtgactagaaagtgatattttaggaggcccaacatgtggtgagcactcaggtctgtgaataatttgcaagtccgtatctaaatgtgcagagggaagtctgcacttgctatgcctgaactgaagacaggagcaaacaaagggtgtgcagtcaagaaatgacgagactcaaaaatttctagataaaagaccaataggttctagaaaatgtatataaattagaagcattggccaagctacagatttccaacttttaatgcagactaattaaccaggcgggtgcaactctggttgaatgactaaatccagatggaaatgcctggattttcattcttaggttttaagtttctccttagcgattgttgttgtggtctaattggtatacgagtagagtctctggctcccatctcttgcatttgcatgccatcacatgcctccctgccttatctccccacatactttgtcttgattttcatgattcaacaaaaatgcttcctttctatatccatccttctcttgccctggaggcattatctaccactttcatacataggccccatagtactaagcaattttctctatagtatcttttatgtttcattgaatttgttggttcacaagttgtgacccctgactccatgggcttgacagcagagactttgtacgctctgtgtctgagttgattagggggtcagtcatctgatttgtatagacctactatatgccaagttttgcagcaagcaaagaataaagccaactgaatctctgacctcaaagaccatacattccagtgaggaaggaagatttgtataaacacatatacacatacataaacaaaataagttgagccattgatatgtgttctacaggaggtaaaatagactaaggcagtaaagtaggcaatgcttatagtgttctgggaacatagatgtctataacgaggcaacatttgagtagaaacatgtacgttgaaaagtggcagggagtaggggtatggtgggaatgttttaagcagaaacatagtataaaattcctattaaaggagtggaattaaatgtttgagcaactgataaaagccaagaagggccagtgtgactggagtgaattgaaggacacgggagttggtggtggaggaagatgaaattggagacgtagacaagagaaaagcaagaacatgttgggctttgggagctgaagaggagtttattctaaacatagtaagaagccatcagagggtttaagcacaagaacataaaataatttgtacattataaaggcatttctggctgttgaggatagcacggacttgagtcaggccagagttgtgatctaaggatacaagttagaaggttgtttcaattttcaagcagaagataatggttgctttgtcctgagctgtggcagcagaaatggtgagaggttattggaatagggattcaggcacacagcatacattcaataaatcataactgaatgaatgaatgcatggcaaattaacttcttaccagctatgtgttttttggctatgtacttaatctctttgagacttaattttcccatatttgaagatgattataaattgatctcaatttataagaactaaataagataatacttacaaaagcacctagcagccaatatgtattcaatagataactaatttccgttctccaattttttcttattttcccaaagcaattcattgtgtgtgctaccatcagattaacctccttaaagtaaacatttattagcttactatataactcagtaaacatatttattagcttactatataactccaatttctataatggcttttaatttactattggaagaatggcctttaaggtcattcttgatctgcccctaaattgcatttccagatttacctactgtatctattctctctagctacaatggatactcaccattctttgcactttacctcttctgttctactgactttctctccatttggaatggcctttcctcaattcataccattcaaattttctctatcccttgagtgatgccactcatatcatgtgcaagactctggtaggccgttcaccgtatgtacacagccttatttccgctacactataatctcctgcaggcatgagccatgtctcaactatttaaaattacttattagacaatcctttccataaatagctatcctattggcaactatattggaatggtaaaacttgaatttgttagtgtttatatttgcaattctgaaaaatgaaattcattagttactcaaaaaagtcacagaccatagggaacagtatgtctcctcctcattcttcctactgtggatggtttatctctgtcagtgaaaagagactttattcacagacctctcactttagcatgctattctgggatgccaatttgtggtatgactgtccaaataccatacagcactgtcccctctgtcactcatgatggccatttcattcaccttctatttgatgcctgtcattttccccttcatactttctaatgtatcttcctttactttctattgtcactgctaccacagtttttttctcagcctttaattggtccttctctccaggcttcttacactgacattaaagaaaaaaaaaatctgcctggaagataaactttatggcagagtgggtgagaaagtggctcccaaaatcaaattgcttgagcttgattcctttgcctgtccttttgggctgcacatccataacaagtcactgtattttgctgtgattcagtttcctcatgtggaacatgaagctgataacccatctaatagggtttttacaaaggttttgtaagaaaatatgtgtaatatgattacaaaagtaactcacacaaaaggcaatggtcaataaatgtgagcttctttcttactgttttttgtttgtttgtttgtttgtttcgttgtttttttttttttttttttggcagagttttactctgtcttccaggctgcagtgcaggggcctgatctcggctcactgcaacctctgccttccaggttcaagtgattgtcctgcttcagcctcctgagtagctgtgattataggcacgtgccaccatgcctggctaaatttttgtatttttagtagagatggggtttcaccatgttagccagggtggtctcgaactcctggcctcaagtgatctgctcacgtcagcttcccaaagtgctggcattactgacatgagccactgtgcctggccaggttttactttaaataatcatagcactgtcctctaaagccccttcagtctttcctcaaatgtctaaaagattatttttaatcttcattacaaagagattcctggtttaatcttgatttaattatctaattacctttccttctaaccagaattgaaaagtactttcacagtttgtgcattaccaattccacctttgcaaataccacttcccagagctggtaagttgatcgctactttttcaactatcaacaaccttgtgtttacttaactcctggcttcccttttatatgaaatattttgtgatcagcccaatctacaattatcctcttctcctttaaaatctggaagcctgtagtgtcaatctcactcatagagatcactggttaccaccatgtgcccgcagcctcatctccaacccaagacagtaaaatcctggaaataagagtttgttcttcaaccgtatcatgcatctttctctggatgttctagtcaagaacatcttttgaatgactgctaaattgtaatccaaaaaactcacaatgttgacaatcacctaggatccttgattatagggcatttttaaagtattctatatttttataacttccaactgttcattgcatctcaaaaagaaataagaattctgcatcacagttacccaggttggctgcagaaaagattacaatgttatatctaacattcagaaagacattttctagactaactgaatactgccaaagcttttgtttaagccctcatcaattgatgatgatggtgatgggctcctagaatctctctatctctcatttggtaacttgtcccttccaacctccactgagaccttcctaaacacaaatctttttgtaagactcacctgtttaaaagcctccctgactgtcctcaaaataaaggccaaatatcttacacaaagacgcttcacaatctggctgtctccctggctttttctgctcaactaacacaaatatttgctattacccaaatacctcattcgattttacccctccatgtcttgctatatgcccttttcttctgccaagagcatccttcttcacatcaccatcataacaactttaacttatccttcagacagaactcatgctttatttttttctattaagattctaagtcctctcccaggcagaattaactctctcttctatgcaaataccataacttgtatctattatacttgtacttattatactttcacttaaaatttaaaatgtaatctaaatataattaaataaattgcattacaatttaatacagtaagtgctataattgagatacatctaatgcgctctcctgttcatctgaaccagttcatattcttataagatgaaatatagtggtttgaaagagcaaaggttctggatgcagacaaattaggctttggatcacacaaaacagtaactaatgtgcatttatcacttactacctatgaagcactatcctaagtgtttttatgtgtattaattcatttaattttcataataatccaataagatacatattgacacacatttgcagatgagaacaccgaagaacagaggccagttggagtcatggaaccgtcgaggtgcagaatcagaatttgaaccccaataacctgtccacagagtcagctctcttaacctccatgccatctcttagccaattaacatttctgaaatttttcataactgaaaaatgaggataatagcaccttccttattgtaagtgtaaaataaaataatggtcccctacttttctttcttttcctatggttcatttgtttttagaagtggcatacatttatttgacttcctggttaatacataaggtctttaccttcttattgtcacacatttcaatcctcagcattataaaagaacaaacgaactgtggcttttcttttcttgttattccctagtaatatcaggttgtacatcttggccagagaaaagttagcctagtttaaatgaatgagatagaaaagttgaatttgttgccattcatttcatttcaattgattttgtaataaccatacaaaataattctctgggtgaaaaatttaccttcagagctactgatttactatggcacataagaagtacttactgataaaaccagaagaaatacatatgtggcttgataagaatgaagaataaaatataagtcaaataatgtgacaatgcaatatacttaattttgcatcacagaaaataaatcttccttacataatagtagcaggaaatgtacacagacttcacactattattaattgtaaaatgtatattgtttcactaaaattcagctttcaagagggtaaataggatgtaacctcctcaaatttcaaccaaagaatggacttattattcaggaatccatacttgattaagtctgtaaaaactaaaactacatatttgagaagctagttgaaattctggtcagcaaatgcaaagtatggtgccaactcaattattttttttaacatctgcaagctgaacatgtatatcttagttaacataattattctaaacagaaatatgttacaaattccaatcagttgcttcagaagattgattacctaactatacatatttagcttcataaaattaagagtttcaaattcaacattaaatttgacttgatttgaaagcaaagcatactgtgattttgtgtatgtgcaagtgcaagcgtgtgtgcctgtgtatcctattattgcatattttcacatttggtgaaaatgtatgaaaatccatgacatatttaagtagtgttttattcagattccagtaaaacatgctaggctgtttagatttcaaataatttcattacattggaactaaaattcattcatatttaaaccgtttatcttcaagcttctctgaaatatagggcatagtctcaggaaagaaatgtatttgggaattgagttgcgagttatgtaatctccttccttactgtattttgaatttaaatattttcaaagccattaaaaaggtataaatacccccctgacacacacacacatacacacaaatatgattgaatcatacaattatttatgctgttattgaaaatgagaggggcttatattcctccccattaaacaatttcacttttgcaagacaccatagtctgtactttccagtcacttcctaatagtaattggggacctactggagaatattgtaatttttcaggttatatgaataccacttagattagattgctctagtgtttcatctaattttaagccctcttttacccagtttggaagtgtatagtttgtatgcttctgaaggtacagacaagtagataataatattagtaagtacaaagaatatgtcagtcactcagggccatgtagcaagtaagtggggaagatggaatttaaactctatcttctgattcctaattcagtgttgtttgctcctcacatcttcctatgtcatcttcactatgttgtactatcttccctgatattatattatccaaagctttcttttagtaattgtactagggaaatggtgttaaggtcctaaaatgtttaagttcgaggagcatgtgtaagacaataagaaaccgaattgtagaatgaagtccattatatcagtttcttacagtccattaataagaatgcatcattcattcattgtttttcaatatttaattcaataaggactcaggggaattaagttttatttcttgaaattattttcctctgaaaaattaaaaatcattagaaaacagaagacaatttatatgatgacatgaaaactgtgttttaaaactcaatgtctataatatttgttattttcaaaaagagcttacaatattcatttggccaacatggttgacgagtactctaaacaaaacctgccttgcatttttaagaacaccttactagagcttttcttaattcctcaatattgtaaaacatcctaactgaagcaaataatacatcaccaagtcattttggcaatggcaactgtaacttaaaattatattaaaaataatataaaccttactagttaataaagtaatattacaaagtacaagaatttgtactggcatacaaaatatttatatagccaactagtaatatgtttaatagtttcctggataattgtatctcattgcagtcattttattgataaaaaataacactgctttaaatttaaaagcaataccttcttctcagtccaaagtgttttaatgagctcaccatgttacaaatgcagtagtctacaccaatgtaaatattatgcatattttattttacttttttactttgaagtcaaatttctgttaggaatagataaatactctaattttagctcaaagaaaaggatttaaaatttgaagccattatctgagtaattcaggtttttaaagctttagaaatcaaccagtagtacaggaaacaatgggaacaacacacattcaaccaaaaccaaggattattcttggctctctatatgtaaaagctctccagggaagaacagcatttaacccttttcagatatgtgccgttctattcattgatgaataagtttgtctcttgaacataacacaggtggaacattaagaaaggtagaggcggcccggcgtggtggctcacgcctgtagtcccagcactttgggaggccgaggcgggtggatcatgaggtcaggagatcgagaccatcctgactaacacggtgaaaccccgtctctaccaaaaatacaaaaaattagccaggcgtggtggtgggtgcctgtagtcccagctactcgggaggctgaggcaggagaatggcatgaacctgggaggcggagcttgcagtgagccgagatcgcgccactgcactccagcctgggcaacatagcaagactctgtctcaaaaaaaaaaaaaaaaaaaagaaagaaagaaagaaagaaaggtggaggcaattcagacaggcagcacaatcaatagtacctgagtggtctcaaagtatgacttgagcctggctgcttgccacattgaccctttagggaattacttgaaaactagagggaaggagtctagaatgtcttttgacatgtgtataataaaactgaagaaatacaagtgcccaaaagcttacataattaattaaaatgtgaacatttctctgaaccaatgattccttttactgtgtggaaataaatatgcttcatgattttcatttcaggtcagaggcagtgcagcttgtgttacaactcaaaagagtaatactctgaaaaaagaaaaaaaaagatggcgctgaaaataaacatgttcagcagccattgtgattcaacttacccagatgtgcttttcatgagatggagaaggacggatggaaaagaaaagcacacaaatgttaatggatacagttcaatccaaagaaaaccatggaataaaacaagagcattatttaagatgtgagaaagctcaggtatgagaaagacatggtgccattttgtatttcatcatgacacacatactcactgcgtcgaaaagcatagtcaggctgagggtagttctaatagttgaccaataagtctatgtcttgagtatgagccactctgaaacatgcatgaccacattttcccagcctcgagtacatcccaggaggaaatcaagaaatcttggtaaaggacattctttacctcaggccacttccatgctattttaccagtagaaacaataacttattaattggcacttagatttttatatagctttataagcctactgctaaggcccaagaaaaaagaacagcagacattagaatgggcagcaacttgaagtgaagaatgtccttcctagtttgaggatctgaaaatctagattctatttctcatacacagtttggtcaaaattattagcagattctgatcttcaatttcctcaacacaatccctggcaatagaaatgtgtaaagtccattccagatccataatgttattattccaaccaatgctgtaataataattactattttggtaaacatatatggctagtaatcagaacataagaaagtgtaaaaatgttctattcctcttcttcggtggccatattacttccttctctatttgactggcaaaataaacatcaagtttgtgtctattgtggctctttcagtggtagaaatatttaattatttgaataggtgtttataaatgttgtttttggggaaacatccataaattatattggttcaccaatattaccagaaatcatcactaaaacgacattgatacacatatagcttttgaagaacccacttgctccctggatgtagtagaggcattgagaaaatatggaagttaaataattcaacaaaaattcatgagagtattgttttaaaaatatattacaagcataatagcctaattattaaaaaataaaattgttactacaactcataaaacatgttcaatataacaaaatagaaagcagaaattcctatgtcagaaattaggcaagttagagcatcttcttttttatcgcacaattattataaagaaaagattgatgtgcaatggaacaccctgcacatgcctcctctcaaggcattcattcagagaaaccgtgtactttttattaaatcggcactttgaaaaaaatgcatatttttggccttaactccacagcatctgtgggaaactccttagattttcacataaacaaaagcagaaatgttcataaacactggcactacactgtcccaagaaatttatcatatttttcacatcatacaccccacagaaatgaaattaagaccaaaaggagatagtttttagattttaaaatgattttcttgtcaacatacctgtgaactctacgatgagctctgaaaaaataggcaatttctgagctttccaggaaaattgccaaaagcatttgggactagttatcaccatggacaacataatctttctgagcctactagctatctaggaatcacttccctataaaacaagttgattaaatttgcacgtagtgaaacctaatatttattagatgttccttgatcattttttaaaatagaaaacttacacagtataaataccttaaaatataaaatataagataaaatatgaaaataaacagaaaacacaaatttaaaagatactgctcaaaaagcattgcacaaatttctaatatttttgttatcaattcgtataaattatctgatttctcatagtttttatgagctttcttctcttccatagtaaataaagttaagaactatttcaagcagctatatcactttagaatgttaagaatttcacctcatgactttcaaacaaatgtgttctgcaaaagacaaaaatctatagttataaatgacccatattttgtgctaatatattataaacttcatataggaggtaatatatatttgcagagaagttttttctgattaatttttcttattgtaaatattgatacattcttttctacacatatttatttatagtagcatatagcctcattatttttctctccatgtcagaagtgtcaaggctatgttaatagtaagaaagattctgtcaagaataaatattcttcagtgaaagaccattgtgagtaattggcaagtaagttttaattaacataaaaaaataggttatgttaccatctaatgaatgagatcagatccaattattgacattatgttttccttgccaacatcagcatatattcagtcaggagaagaagaaatgaccagcaaacatatgtcttatatttcaaaatgagagccttcaacttttcagtttcctcaccttgatcttccagatctcctacaattgaatgaaccttcttctgttataaactagtcaattctggattgaaaacttcaaataagaaacaattcattaaatgagttttatatttggaatataattgactcttgctttgtaaagttcaagttggtgattcagacatatttttaaattagttattaacatcaaattgagtagttaatggctggtaactgaaatggaaaagtaaaataaataaatattttttttaataggtgaaagttgagaatgtttaaatgctgatgggggaaaaaaaaagacaggagcagaagttgaaagcaagggagaattccgcacaaaatgactaagaaaatggaaagggatgatctgagtaaaagaatagcctagttttctacaataagacagatggggcaagtgttagtgtatatttggcatcaagcaattcagggcacttggatggtttctctctctgtctctctgtctctctaagctagaatgtaaactcatcagcagaagattcaagtttgaggagagtggaggtttctaacaagagttgcagagagtagaacaacactaatgaaagaaaactcttgggattactaggtaatgctgaatttcacaatgaaactatttctaatttctctgctgtaattttctccaacagcacagatgtgccaaaatgtacacatggagaaagaaaattcatcattgggtgtggttgttatatgtagatgtgaccaaatgaaagtggagtgaagaaatttaacaaattttgagggtgttgaaattatggacgtgatctaagctaaaccaggagagaggggaaaacagaaaggtgataatgcactggaaaaggatagaggttaaataaagatgatagaagaaaaagttcataaagcaagatcaaaggtgggaagactgtgattagcaagaaatgagatgcttgaattggtaagtttgaaagaagcatgatttgtggtgatgacaagattcagaataggaccatgaagagtgtctgacttggggtaatgaacaacaatggaagcaataaagttgtaaaatcaaaaggttagtttttgaatgggtgatctatgtggatatcagagcatacgagggtgacatcaagaactgcttaaaattcctacttaaagacagatgatggggcctttaaagataaatatttaagcatgtttctagtgattcttacaaatgaaagaaatggttcagaagtttaaatgtggttcctcatcacattaaatataacttttctttaagttaatattgacttcaaataactaaaatatttgagactacttaaaggagtttaagaaatctttattgctctaagaattttgttaatcatctgcctagcaaacctaatacagttaagcctcaaattaaaatttcaattatggagaatctgaaccaaagatatttaattttatgtttgtgtgtgtgtctacgaaaatatacttaatacacacacacacacatatatatgtatgaagtctttttgtattgaattttttgtctgtaaaaccccggcaagagagagactatacgtaattactgcccttcttagaagtgtggagacagatacatttacttcatgaatggctcatttgaaataactatgggaagaaactaaatctccaaagatcttataaaaaatactatacaaagcttatatgagattttatattaacaggaacagatgtggaaaattctagattaagatgtcagcattatatttaaatatactttaatttgatttttttatttaaaaagccataattattcttgctattagacactctcttgtaagttttactggaatgaataatttagattgattcaagcacacatttaaattccttacatggtttatttattagggaacattcacattattatatcttatatcaaacattggaacattatgtgtggctaattatatcagaaaaagtcaattttataaaacagctacatctcgtgttttgaaatcctccccatccccactctttaaaagcatgactggtttgaatacatttgttgctcatttttaaggatagggtaggggcagataagaaactaattattctctagaggaaaaaaatatgctaccctttccagagtataaagagactggggaattcttcattcactccctatatagaccattaacattaaaagttatataggatattctaagtgcagttgagattggactacatattctttaaatcacagccctattcttagatactaaataattccaaggaaaactgggctctggagatctacatttttgtataacacagtgcctggaaagctatatttcttgatgcataaaagaaaatagcagtttttacattaaaggctttgtgaaaaatattagagataacacatgtaaaatgcatagaacagtgcattgcctagcacattacaactaatcaatgtgattattatgtacatattacatataaaatagataatgtcattagcatgcaaaggatgaggaaaaaaatgaagcagaatatatgcacacaaggaggtaagagtaatcaggaacaaaacaaatagatattaggtatatcaagaccatgaagtgcaagatgggaagcagagagataaagctggtgagatacacagggagcagataatgtagggatttatggactacataaagccatttgaaattaatcctagggttgttagggagtgattgaggggttttaggcagctaaaaaataagatttagataggtctgtttagcttaagcgtgactaacggattataggaaggcaagactagaagcagaaagactattgtagtatgatggcttgagctggaaagaagaaaatcaacagatttgagagattttttttaaaaaatgcaattgactacatttggtaatagtacatggacgtgtgtagaggaagaattaggacaaggaagagcagaagcaaagaagaaacccaggtttcaggtttggtcacctgggtagaaatcactgccctaactcctattacattttctcaggttttcttctttatcctagagttctttccttatccagcttctgtttatacattcaattatttgagaaatgtattttaaatacttacaatatgccagcatctatatgttaaaaattcaaagattctcctctgttcagttctcttctgaattttacagaggatcacagaatctcagggcagggacaatttaaaaagcaggtagttcaaactctcagccaaaagttgaatcctcgatgcaataatcctactatgtacatatgcctgtcaggtcaatattagacataattatggtgaacaattccctttcaaagtggtcaattctttcttcctacctctgtgattgctaataattctcctacagtcagctcaatttatctgtactaacccctgacttctggcctaaggtcttatcacaaggccataaagaacacgtttggttgttcattctgttggcagcatctatatctttgttctgtatataccacatattcctatttctaccagtctttgaggacatggctttgtgtcatctcactagtatggtcatgttcctctgaacatatgctggttttaatccactttaagtaactttcccagaaatgaacacaatacccagctacaatctggtaaatgcatcgaattttgaccctgttactgctattacggatattgaaaaacattaaattatttgtcaggcattgctcatttgcctaccttgtagaaagttttttcttaggagctacaggtaaattatatatgttcccctatatagaggaaatcagtaagtatagtcctaaagctggctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatactgagcaaaagaatgaaaaattatcattttcatgttctattaatattaatccaggatttacatcaattaagataaataagaatttatttagaaaatgacattatcttctattatatgtaactatcttgattttaatttttcatatactaatttttattttactctttccagatcaaaaatgtttctcctggcagaaattatggagccagcacagggcttctgttctactcactttgttaatatattaacattgaactgctggctcaaaacagcaactctattccttttgtgctgttttccttcctctaaatagatcaaatatatctaaatatatctaaaagagaacactttggttttccttagctttctttttactaacaaatttcagtgcattctgacccttatccttgggatattattattatttacgttcagggaattcttataattgtctttggttgaaggtaggtagggctatacatgatcacatggcaaagcaacagcagctctattttagtgaaaacagagaagacaggcttctggagttccaagtaggaaactgggacatatttttccagagaaattttgaaagcattggttttaggttctaaaatgttgtatattattatattcattgaattagttgccgaggaattttcctgcagtaattgtgtctgtactaaataaaccctcgactaaaataaacaaactgatccaagcacaaatatctgttccaaactaggccataaaaggatttcatctaaggacttcatttttggaatgggatgaaggagaatatatgtgtttgtgacaagactgggaaaatctctcatgatctcttattgtcaaagttttgggaatatcttggctctattgtttctgtaatctgtgagatatcctggctctgttgtttctgtaatctgtgagataatctaatatcatgcaagtgaatccttctttttgctttatctacccagagacagttcctactgcatgcctacaaaacaaatttttgtgggggaagcacagacttttactttctgtgtatatagaatactcagatgggaaaatgtactcagagcttctaacacatcttataaattaagttctggaatacagttcatttaaaagtttaatttggcatataggcacttaacgaatatgtattaaatgaaagaatattgtggagtttctgtgataccttcacatataaatattttccatatcatttattttgcttacagatatgtacactctgaacctgccaaatgccaaagattaaaagtgcagtctcaaaacacattaaagattacacactgaaggagaccctcaggattgtgatgggaataaattaagtaaatctatagagcttaacttttatgtctgtgatattctaacataaagatttattggtagtaattaagtgtgactgctttgctccaaggataaactgcttctcgagagaggatgctgctgatagctgagtcggggtgttaatttcattttaatgatattgaaaaatttgttcacatatgaaatctattttcctttagcagtgttaaccattcagaatacatagaaaagtctaacatataataatatattatctttattgtaactaaagattgaaaatgataaattagtatattaacattcgtatgatatctttcaacttaagttacaaaatagagaagatttcagcatggatatatgctttactaaaaaaattatataatgttacgaggcaagagaaaacattagcagataaagaattaagctaaatatttcatcatttatattgctggagataaataacaattcaatggatattctatcaattttaatatgttcactgcctattcaggatggtcttgagaattagagaggtgaattactgttgaaacagacatcctcatctttaatcccagaagtttctataagactaaggttcttggaatgaaaattgagtgtagaaatgtgagtcctctagagtaacagttgtcagatagtccagcataacaagtcttcagtttgaaagaataaggtagaaaaatgaaacaaaacatttgaatagacacctacttacggcatttctgaacaccaaagataaagcaaaaataaataaataaaacagagagagagagagagaggaaaaagaaatcctacatgttatatacaaaagaatggcaatcaattgatcattagccataactagaagcaagaagagccataacttcaaaggtctgaggacaaattatttttaaccaatagttatatgtttcaggcaattatcaactgatgttaggtgtgacacatattttcaggtctctaatgacttaaggaatttgccacttgccctatcatcacatttctagagatgctgacatgtgaaactgacaactaaatatattccaggggagaaaagtaagaaatttaatgagatatataataaaaatataattaacactgatgattcaaaacttgcttaagcaagaatgttgatgacattaaattttattaattcccttgtaagctcatagttcttgattctaaagtaacaaatttatcaaattataataccataaatgttatttttaatattatggggggcttatacctgtgcaacttgaaagtctgtgactaaccaaatctttctgtgtcaggtagatttaactatttggagcttccagttatgctttttttttccccactatttacctaagccatgctctaccagctttactggaaatatggctgacagtttgatttctaattgactattttgttagtcaacaaataaattctgaacttaggcaaagaagagagtttctatttattgtgccctaaaatactcaaatatagtctctaagtacaatttggtgagttgaaccttattcagaaacacaggaattttggggggcaggcccatgtaggttttaaatctgaagggaccatctatcattccatacagtgtaattgtagctcactgtaaccccgaattcataggctcaagcaatcctcctgtctcagccttaggagtagctaggctacatgcacatgccatcatgtctgtctaatgtatttttattttttgtaaaaacagggtctcactctgctgcccaggctgggtctcaaatgcctaggcttgagcagttctcccacctcagcctccccaagtgctcggattacaggcatgagtcaccattactggcctgtgtggttggctttaatcggctatcctgaacttcgaagcttttaggttaaaacataggctggaaagctaagaatgggaaatacgttcttaaatatgagggcgaaaggtataaaagaaaaagagtgaaattttcaggtctggttgttctaaacgtaatagtaaaagagaagatatttttgttaaataagaagaggtgcctggagttcaaagaaatccaacagagagtgatggataagatctcagagagtcatggcatccccagatgaagtccgcattgaataaactatgaagaattataatattaatactgaaactaaatattgagaataagtgactcaccccttaaatgtcaggagcctacagagaaactgctcaaattttaaaagggaaaaccaataaaattactgtgaagcattcaaagaattacaagctgagttttagtttgacacaattattataggttaactatactctacataaacctgctggagaaatttatggaattgatgctttaaagaaaagtacagcaaagatgaggcatagtaaaggcaaactaggcagagcaacaatagattgactttaggccgaggttacgtgttactctgatgaaacaacaacagcaactgtttaataattatcaggaaggtaaagatggacaagacaagattttcatgactagtgggtggtttagcagattcaatattgttgatttcctatttctcataataagacaatagagagaaatataagcaaaactaatgcctggatcagaaaacaaagaaaaagtaggattaaagtaggaaaacaaatcttgtaagttgttgtaacctatgtgtgttaaatttactggatggtaagtgtgcctcaaattaaacctttgtttaggactgccaagttacaaatttctgaactttgcaaaaatttggaatgtcttaaatgctgctctctgaaagtaactcccccatatggctttttaaaaaatgtaccataattaactcctctagagatttctcccaattaaatttaaagttacagactgtcaattctaaatagctgctatcctagcaaatttgaaaataagatattgtctagttctggctatcctcacaaagactaatgaatctctgctatgaattatgggatagtgagcatagctctgttaagtactaagtcttggaaacaccattttgccagtccaatggatagaatttagaaacaactgataggatagcacaggttgcaactgtgtacgtacgatctgtagtgctcaacattatgaaaaatgttgcttcatttattgtttttatttatttttaaataaaatttacttaaaattatttttcatcctgatagaagactagcaaacatgaaatcggaacccagaaaagagtgtaactcattaaagtgcactgaaagaggatacggtttctttaaaaagaaagaaaattggaattgtttaaatgaaattttaaacacttggaaaaatccaagaataggctgtcaacatttaataatattaataattaacaatgtaaaattcaatagaaataaaatttgaaaccatgtaatttaaaagtaaattgtctatctctaataaaactcattatatgaagacaacttactctctggtaatccagaaatcaagccacagtggcatgcaaattccgaataggtgttaacaattattcatataagtcctttgaacactgattgcatgtttatgctcacagggctattgctatgggataatcaataataagggaaatacttttgtgctttcattaattaactctgacttgccttgttaaatccatttgaacctaaataccattaatccatgggaaataatcgtactaagaaatgttagccatttttgccttatagaatgttcttaatattcttcttaatattaaaagcaagtattctacataacacatcttacagttacattttgccaatacatgttgcaaaataaaacccaaagtcaagcatggtaacatatttaagggaagaattagtatttttttctgactgtgagggtacttagtagttgagaaacgagtctataaaattattatcaaatcaacccaatagtgtataaggttaatgatagctaaactttaaatatgttattttaaatcactgtataattgaaatgtttaactttagtagctatttaaaaagatatttcagttggctccatcaacaactaatgaagtatgcaatgcactgcctcaatatcagacttatatgcaattgtgaaagctgttcagattgccattctttgtcaaatatttgtctgggagaaatgagaattaactttcaagggaaataaactgagtccattagtcaggctgggttttgatcatttatatatttttagactggaaatcaactgcgaacatttaaaaatcttaacaaaggaaagtattttttagaagaatgtttttctcaataaatagtcacgaaatagagtatatcattaattggtaggactaaacaaaacgaagacatttgaaaaagattatgataatatttaaatatatttttgagtgatcagtaactaaagaataaatatatattattgattatggctgagcatttgattgtatggtagaaataattatgttctcaaagtcatttttttctggacaatattcctactgaattgggatatatgtacataatttttagtaactagcaaactaataaacaattaggttagtgagttgttctgcaacttgtaagtatatacttccctattattagtaaacatttacaaagcaagtgagaaagcaaaatatgaagtcaattgattagcctgtatattataatcctaagagcctatctgttaccaaatgatgatgagagcagtgaatattctttcataggaaagaaggaaaatgtgaaaaccaaaaacacaatgtaaggaatatttgagaagaaggaaaagaaataatcaaccaatagattctggaataaagagaaattgatttacatttaaagaacatgtcctaaaggtgccattttgtcaatgaaaatgttactatgtatttttaaaatgttattttgggaactacttgctttccaacagctgctgcaactcaaaattggccaattttgcaagtcatttaaatgtcctatattatatatgaatgaaaagatacactatcaatttcctgacagatgcaaaacaatctgctctgagtctaaaataagtttatattcaatcagtcagagaaatgtttctcctttactccatttcaaagagtagatacttataattgccatgagagaaaacaaagctagatggtataatctcattttatcaaaccaatcaggttttaattttgaacatcaatagcattgcattacttgtaaggattttgaaacaaatctatggatggttacgttgaagaaactgcttatttcaactacaggccaaatatttttatactcttttaaacagtagctcattataaccaggaaacataagccctgagtgttttaggtagtatctggaaaatattggcttcaatatagttcttttgtttccaaccactctctttttaattccctataaataataataaggaattgataaaagttagaaaaagagggaaaaatccccaaacctactttttctttagtcttcgatccttctcagcttgagttccgagtttgcctaaccccagggactcctgagctgcagcttcagtctccataaagcctcctgtgaagagaagtaactaagtattcagattatgttgcataggttgtgtcaattctgaagtcaggttgttaaaggtttagttgagcaactgtttagtatcacatttaaaaattttccttatattactaacccaagatgcataaaatggcatgggtacatacataaacatacactgagaaaatgaaaacaaaacaaagcagtacctatggggatataatttgttgcacccagtggcaacataataaatgtggcctgttcactgacaagacacttaaatatactgtccccaagtcttaaagtctgtttttatacttttcttatggaaaataagagcaaatatctatgcagcgtgtgagatttgtttattttttcaacacgttaagtatttgcaatatttcacatataatgggataaatgatagccaattgggtaggaactcaagtatatgttttctattacaagttgagagaatggagaaacatttgctgacttctaagagctcttcatagactgctcctggaaatttgttctgctctactggctgactcctatgtccttcactataaatcttacttccagaactcgatgtgttctgggcaggttcttgtgttgttttttaaacttcataatattttttgaaaaaattctaaatttcttcaaaagagcttgataaaaatagttatcaccaagtaggtcataagttctcatttagtgtcaatatataatatgtataccttatataactttgtaataaaaggaagaagaaagaaaagtatgatgtacattaaacacatatcacaggatttctaaacttacaaaattaattcataaattatctgttgtaattgaaaaataaggacttactcctatgttctgaagtcgagctaaatgaaaatgctcactatttttaaatgagttaaggtatatactttttttaataaaagaaaattaaactccagttaaggtcaagattaggtagaaagatttaagctaatataaactctcacaaagactatgcaagaaatttcatcactatatcagtaaataactattgaagacaacttttgctcttctctcattgtagtggacacttccttacttaacatttgcaggactcgaccaagatatggtttctctttagcaaagtaaaatatcttaccaaggtgccaaaagcaaattttgatgttactgtttttaatactttattttaccaaataatttataatactggataatattaacttgggaacattgatataaataaattaatctcattcctgataacctttttactgaactatataattttttaaaagtctcctttaattaaaaacacatttattgctgtatagatctaattcagagatgtggagtttgagggccaaaatttgttttagttattattcacatgtttaatgaatacgggtacttaaatctttttttattatgaaagatttttcttcttggtatggattaggaaagccttctactggtgactaaagtactcttgggaaagaaacattttcaaatgggaaattttccattatgtacagtgagtgcatattttcattttatttctctcatctgtatatttgccttactgtatatcaataaattattattcatagtcttcaaataataataaaaatgttttcttgaaatgtaaatgaaaatgaatgagtcacttaaaagttataaaattcttgaatggtccatatagggacatagagattgatgaggcagacatattcaataaacaaggaaagattttcaaccaccaggtggctagatgaatcaggcttttattcttctgagcaatataagaacatttaaattatgatttaaatttattcatatacccaaaattttaatagaaaaaaatcacatttttaaataataaaacttgaaataaaagcaaagaaaaatctaggaatattttgtgagttaaatctagacattttattttctcataactataaaataaaaagcatgaagaacttagaaatactcggagtattgcaaaatctagtatcttttttcaaagcatttgatagataactggaactacatcctactcaaaaatgccaagtacaaatgggacgtaaggccattgtaagtaaagctatttttaagcaacacattcaggccagtgcgcttaaccaggagaaaagtcccagcaagtgcatattttcagcccaattaaaacacttctgagggaggacattttttcacagaattgacctagctgcttcactcatctaatgtttatctttccacatacttgataaactagctggtaagggtgaccttagccaaaccagcttactaattattttactctatggatgattatctaaatccagtgagagtctgtctcattcttgtctaggcatcagtgggctcatatggctatgtgaacttcagaaatatctatttatctataccaatattttattcactccctacatgtgactattaagctcttgaaatgtgcctaattcagatgatgtattgtaagtgtaaaatacacaccaggttttgaaaacgtggtagaaaaatacatgtaattcataaattttaagtgatcatgtgttaaaatgagattattgtttctatatcaggttaaataaaatataggattaaaattaatcccacctatctcttttaacttttcttaatgtagctaccagaaaatttaaaattacatatgtggttcacatttgtggcttatattgtatcaatgttggccagcactatataccagagtttctacctggatacagtacatccacagagggaatgtaaatgtttgtgtatgttgagggagggtgcatttttttgggtattataatgattggcacatattggacaggggacaaggattctaaacatccttcattaaatagagaaactgcagcttgtttcttttttctttttttctttctttcttttttttttttttttaaacagggtctcagtctctctcagactggagtgcagtggtgccatcagagctcactgcagcctcaaactcctgaactcaacccatcctcctcccaagtagctgggactatagatgtgtgccactatgcccggctagtttttctattttttgtagagatgaggtcttgctatgttgcttaggcaggtcttcaactgctggcctcaagggatcctttgactttggcctcccaaagcactgggattacagatgtgagccaccatgcctggcctagcttgtcattctcaaaatgatgagtgcctcagaggagaaacactggcctgtggaaactaggggttactcattcttcaggaggtctattaggaaactatgtggaaagaacacaatgaactccacccctttcatggcctgaagtgcttgggcttgaaggtttgagtcccatgattcagcagactacttacataataaattgtttatcaccttgtcagggtccgcctagtggttgggcatgagcaaggcagccttcttgccctcaaagttttcttggctatcactcaggcatctttacttttgtgaggccttcgaggacttggaattattgagggcaagaccactcctaaggtgtgacaggcacagtcaaggatttttttttgccagcccctcttcctgtgtaaacagttttgaaccaccaaaaaatcagtgggacaacgatctactgattcaatctcatacaataccattcttgccagtgggagcgagggatccaattgccagaccaccctcttgaaaacagggtcagaccactgtctcaggatgactccatagatgcgactcactaggctccctggggcatctggtcgagtgcatgcgtggcgtagagtgtcaaagaaaaccctgaaggggagaaacagggacccaggctcctgctgtttggctggatcgggcaacatgtccagatggcactacttcccttctggtcccagtgtctgaacggtaactgagaacatttcgatgcttccagtgattagaccccgggtccgggtctcagctgggggtgccttgcccagatggcactgccagccctgaactttcccagacatcagagggagtcttaaaatttttcaaggaagttgctacaaaatgtagggcttgcgaaggctcagggctcagggcacaggaaggaaactcacatgcctagatctgtggatggaactagttggaggtatctattcatttggattgtgaaggtgtggaagttgttagaatcaaaatggagtcactattgttaagaaaatcctggcaagtagagccagggaaggccatgaacagaggattctcatgctcctacgcacgatagcaacaacaacaacaacaaaagaccctacgaaagccacaaccttgcacgaaggccattgcaatcccatgccaaaaaatatttttataggtatatctgtctggcaattgcctgtccaacctctgactggtggcacgcttgttattaatttgagtagccaaagataattatttcaaaaaattatgtaatgttcttaattttttgcctttaaaaatctttgtcttcctttccttccctgagtatacacatagtttatagtttactatgacatacatattcttatcacaatgctctattcctaaataaacatcttttcttttagagagcatctctatttggtatttaggtcaacaaagacaaatatctccccatttcccagtccttaaatttcattcaaaatcacttatttcatattggcccttgagatacaagtctgtagaaattgcttgacaaacccatattgcaaggcctctgtccttccatttgtccagcagaggtctctgtcattgtgtgaaaaagagatctctaactactacaatctgctgatgattggtggcttcatctttctttcagtagaactgtcttcatcattaataaatagcacatggtttgtattaaaacacatttgaatttataaattgttacttaattgttcaacatctgttagtctgttagctatccggagactgtatctatacacagtgcctggctcataaagggtatgtaacaaatacagtcataattggagctaaatactactttatttaaagaaagaccctttcactatgcagagcatgagtcatttctaatggacactttgtggaatttacattgtaactattggttccttagcaccaaggaacaatctaagttttggcgtaaaggccgacacagacacccaaattttagaggtagaaaaatacagtcatgcgccacataaagacctttctgttaatgatgggctgcatttatgacagtgttcccataaaactataatagcatattttcactataccttttatgtttaggtacacaaatacttaaccattgtgttacgattgcctacagtgttcagtacagtcacatattgtggattttttatagcaacaggctatacctatagtctaggtgtgtaggtggctattccatacagcctgggtaggtagtaggttatattatttaggtttgtgcaacaaaatcccctaagggatgcaatttttagaatgtatccttatcattaaacaatgcacgactgtacttgtgaaatgatgctggtgtactgctgaagctgtgtttttgtcactgtgaaattatttttttattaagcctattatagtaggtcaatgagttcagacaattataatacaaactggcagataaccataaaagaattgccatttagaggcaaaaaaagctctttaaatgtgtatattgcttttcatacgcatttaaaggaaacttgctaaagtggccctaacctaataatatatgcatttttatacatgcaattgggaattctgcttattcatagttaacgtgcttttctgttttcattatttttttcatagctttgttgttttggctctatttgatcactcccttgtcttgaatatctctttgtcttagatttgtttcatcttttgctatgcctgtcagtagcctcttctttatcctaaccattcactattgacatcagctaagttggtcagatgtgttcttgtttcttcattgtaattattagtagagctctgtgaagactcaaaagagttggtgtttctcaggtggcaaacaaatcagtatgttaagatggtatggagcagttaatttccctagaaatagtaaatgtttaaatatttctgtctcttctccatacactatcatcatttttctaagctgacaaactgcctctggaaaacagagctcgtttgctctaatccttaactctcacttctgcttggatgcttgaccctggaactcagatcatcttatttctgtggttggctctgcttcaagatgctgcctcccaatctctgcagttccaatctgtctgtggctgggtaacttgatctttggtgctaatcacttcctttgcttcataagctggcatcacacttctgacccagccagtacccacttcctatttaaccacagaaaacgccatttccatgacattctctctggagcttgctgtttaacatagtttcaatacccttttctcaaagataggtcccgtttgaaactctacctttacaccttttcaaatacgtaggaagattgcacttagatgatcctagtagaatcaaacatatacagggagagaaagattaacccagaactctctccaaacattatgtctgtatcttgtattagaaaaattataatgtttctgtgtgattttttattgttgccttgagttattatttattcatttatatgggatatcctcaagatgttatatacttcttgaataatcgtatttttaatttctttatgtgcccacacttgttccacagggataggaactcaatgaagtattttttgattgaaataatcccaagagtttcctttccggatcatcagaccaggaagtaggagccaggattcactatcaactctcttactaagtagctgctctgtcttctgaaatcatctcagtttcgatatgtatagaatgtggacaactacatgatcctcacatatcttctagaatctttaggcatacagctctagaagtctgtaatcttaaaagcagaaatttattttcatagtaaatattttatggtgttttagttgtataaagaagagttgccagagaaaagacttaaatgttagagattcatagattcagtattcctagggttgaagtagatcttaaagatcatccagtccaatcagctttccaatgcttggatcccctccacaacagctcttcctagtatttgcctagcttttgctcggcaatttccaagtgacaaataactcactacctcataagccagcccattttgtatagaattctgacaccccactgttctttcttacatcgagatgaagaataattttgtacaactttaatactttggttctagtttcgtatccttacttacaatgaaaaggacaatagctcttatacagaacaactcttcaaatgttgtgatcagctacttggtagttcagcaaagggaataaacacaccattcacttatgttctccgaacgtgattccaatcctctacaggtgcctaattttctcctccaaccttcctccaggttgatgatgtgcctttaaaagtacagtaaccaggatggattccattgcttggctgttcttttatcatagcagagtagagtagaaaaaactttcatatcaactcttatgtctgttaatgtggcctaaacttattaatcaatattgactttagagtcacatgaattttttattttttttctttaaaaacttgcttccaagaactatacttttagagtaggagaatttagatcccacttacatccattctttctatttttggtgggggggatagcatttaggggtaatactaatcttttcacttaggattcctccccttattagtaatccatcaatcagatacctgagctgtggaaacattcatatccaagtgattttggatgtgctgatcaagaacagagtgagtcctaatcatgccacgagaaactttgatcccaggtgacgttactccactcatcagtgggcaaggattatttaaccagttataaatcccacctaactgttccagcactcaggccccattttgacatcttgtccccagggatgtcatgagtgatggcttgctcaccacctttcattatctgttactaagtaaagttgccaaacaaacaaaggacattagtctgacatggctatttttaacataggttaatttactttgtttcaaaatagattaatgccttcagataaaattaaaagtcaagctagtcaggactgcaattatttatgcatgatcacagatcttagggttcatagccactgttcctagttctgacaggacagacaatgtagcagataaaacttttctgggccaaaaatatagtgaagttttagttttaagtataaagtttgtatttgtttacgtactatctttgctaaagtgaaaactcctcgatgccgatagccatgtcttagtcattttcctaaagtccataattggtactctgcatttaagagtggttcaatatatgtctattcactgaaagtaggaataaataaattattttggattatctatgtcttctctccctccaccaaaaaaaaaaaaaaataaatctcctcaactctgggtcataaatgccctcttggtaatgcctatattctggttgaactctttctcttcaagtaaacagatagaaacaaaaatgagtttttgaatggttccacttatttgcatattctattcacatcagataaatcttcatttcattcattttctctaaatttatacattactaaacaaaagtaacaatatagattctataattctcactttggtcttggtgatttttccaattgtctgtctgttttgatggatggcattcctgccactgcttttacatgtcgatgccacttgcttctatctattatttgtcatattctcactttccaatttttgtaacaaatcatttcatgtctgttttaggcagaaaactcccatttcagatacattgcttcttccttaatccacatcatcataaatataattgtgtgttaccatcctctggaattgctttgacagtacacagcctttggtgtcctaactacctttccatgttagttaagactgcacctatttctagcgtttcagtagcagtgtgtttggaattgatgctgtggtaggtcgtaaagtgattgacagatgaggaaagaaaaaagtagtgaacaactcagtcttgtacattaaatgcagggtaaagataagtcaatatttggagataatggcaagatcaagtgatagcttttaaaagtgtgaattagacatgagcatatttgagcaataatgaaaatatcagagatgcattgcatatggatgcataaattgaggggtggggagagatcatggtcattgtgctgtcaagtcttaacaggatgctattacatcctgaatctatgttccaggaagtcagcagaagtacatatcggtcctgttgtcatggggatacaaaccaaacctgtttatttaatttttcatcctgggatttgtgacattgaaagacaataaatggccaggcacagtggctcatgcttgtaatcccagcactttgggatgccaaggcgggcagatcacctgaggtcaggagttaagagaccagcctggccaacatggtgaaaccccatctctactgtaaatacaaaaattagccaggcatggtggtgggtgcctgtaatcccagctactagggaggttgaggcaggagaatcatttgaactgggaggcggaggttgcagtgagccgagattgtgccactgcactccagcctgggtgacagagtgaaattctgtctaaaaacaacaacaacaacaacaacaacaacaacaacaaaaagacaatgaacaaaaatacaaagaaatagaaatgactctaaaaccagatccccgagtaagctagaaggaatgcttcctctgttaggtgggtttccctaaattcaattgtggccttcaggtaaacttggcttaaattatgctttatttttcctgaatagtacttacaaatggaatttgaattctttacatggaagaacaaaccctcactgattcatttgagtctacatcactcctatttattttctgcccatacactgatacacatttcagttgggaaatcttgctcctacattataggtaataataatctaaataagaactgtaaaccctagtaagaacagaataattttttcaaaagatatataaaaacttgaaatctcctattagtaccacagctttttctatcctacttttgtaatttgagtgaactaaccatttgaaaaggatgtcataagaaaattttaaaataaaataattttggttggtttctgttaggtttattcaattgcttttcaatacagtgcttcctttgagttttggggtttccatactgatattgtctatgctagtaatacattagtaagaacagacatattgttgcacatattgagtttgattcttcatgggtaggagttatccatacaatcacatcgactgatccttcctatctgaagtttatgttattaccctagcatttcgaagtattatataaagcaaacaagatatcctttccaaatatttccctttgtgaattactacaaacatctcctttgctgttcatcatttctgatagaaccaaggaaacattttcatagtttcatttatacagctttccctttccacaccatatttctttatagacatgtagtatagctgctttcaacttaagtcatgtgtctctgctcttttgagttaaaccttttaagagttataaatcttagcacatggttcagaatttcaaatttggtactttgacatcactatctctttcccgtagttctttccctggcatactattctattttctagttctatttttactggtagaagaaagaacactggcaatgctcctgggttttagaattttccagatcaagacattaaaatcataatcactcgagatttttccctaggttcctcagatgcatgaataagcagtactaggttgtagtccctgggttggaaaaatgtgcatggtctttccatgacaacttggataccccttctaggaccaaagcagacctaaaactggtagcccttaactaaagtatcagtggggcccatgtatcatttcctttggtgcaaatatggttttctggaacctgtttagacctatgttttatttttatttcttcaagtctcattttcagtaaagactttgttctttttcctggaagctttgattcaccatttatgtagcttctacctagtttcataggtatagcattttgctcctgtcttcctcatccatattgcagtccttaacaagctgctgattctggctttgtttacactctacctctgctgttctatgaaataaagcaatattactcagagctcagaaactttcccaggtataaactgtgacctgaattaacttttgctagtttctgactttggtggggttgatgagaatataatagtaattgagttaattcttatctgctctgacctaaaacacacagtcagtgaaaatgagtaataaaggctaagtttctcaaaggttctatacttttctagactttaacttatatcttgcataccttgattttgacagaatattgttggcaaaatttctaatgatttaggaatttctcatcaaagttaaatatgaaataaaaatataaaattttaagtgataagggcaattaaatatattttaaaagtaaagtgtcaattatggcaactaagatgaatatatatgttgaaatataaataaatatgactatgatgttagcaaaattaatactcaaaaataaccactcacactatagtgactgacactgtaatatattggatatgacagatcatttggtcaaccactagttgtcaaataagataaaacaaattttaaaataatgtctggcatgtatattttaaacacaaaataatctgtgtctctcttttttcctcatgcaataatattatgtatagcctaaagagttcctctactgagaaagaggaatacaaaaagatttaattcctttgctggagaacatataatcacacactggccacacatcagtttcctgtagcttccgatgctttctgtgggtttcacactatggaagccaggaaaggcatttttggatactgtagtcataaatctgcaaacatgaatatcgcaatcagaaattcttttgatggtagggcagaaaactaagtcctggagttgggtattccttgcaaataattattactctatttgagaaaccaaaggatgtactaagaaatttggatcattccattcagcacttaccactgtaggtaggagtttaattctttcccaataatataactctaaaaattaatatatagaaagacaaccccccataagtgaaggatatatataatcatttcagaaatatcacagattcttctgacaattatgtaagtatgtatcatgtatgtatatatctgcttatttctaaatacatatttaagtagtaccatttcaaatgtactgatctacatttttattctattagtcactgacaataactaattataacacaatatctattgccctattcttttccccacatccattcctcaactatacaccatagagtttattagggggaagctatgatagttttaagcaaaaaaaaatcatgttctttacattttatgtaacatattataaagctttattctaactttttaaaaattctttttaattttttgtaggcttatcaattctttcaacaaaaaaacctttaaatctacatagctaagcttttatacacattcatgctttaagtggcagtatactcaatggttttaagctgattttgaaacattggcaccacgatgaatatcacagttatgcgatttatgaagacattatttactcattaataaaataaggtttataccactagcatttactttgtaggcaactgtgcctgtcacaagagttagcattaaataaattctagctattgttataaagagagaaataaaatgactgaaaagttcacaataccctttcactaagttgtattaagcattattcagctaaattgaacatttaaagctaatcaaaatataaattttgtcaggtagaaaagagaagaaatgaaaagaagagcaatgaaatgaaatgaaagatagatggatactgtgacatgactaaaatgagtggcagtggaaagtcttaacacatgcatacttacggagctgcccaagtcgagctttttcttttttaccaaacaaacgtcctattgaagacttgattcctttcttcttgggggctttgtgaagagagtcttggctgctgttggcactaccaagcccgaggctttctggctcaagagagacagataaactactgcaaaacacaaaagaggaaaatacatgcaacatccacaaggtacacaaaagtcatttcctttataaaatgcaccaaaggaggaacaagcagacttgtaatgttgttttttcccctattttcccatgtttccttttaagatattaaatgcagttttttttttcagcctttgggccctgaaactccaaatttccataagataaattcatttttgctccgaatgtctttttttctttacttttttggtataatctcaaactaatcagtgaatataggctgagttattaactgcatgataaatggccttctattatggagcacttgatccattgtctatttatttctcagagtctgtttttctaatcttaaacataatgacctacagcaaggaactgaaatataactattgtgaaattgaagctgctcttctaatctacagttttacttgattttcctctagccatcgttccctttctcagttttggagccaaattcagttaatttaaaatcatctgggtgcaatttggaagcaacaaaccatgtatcctcgtgatcaatgtatgtgttttcctaattagagtactcaaatattattttaaatacatgttaaactgaaatgcttttcaagcagttggttaagtttcaatttatggtcaatatatttgacaccgtattaataggatgggatcaatagacattgttattagtttctatagttgttaattttataacaccatgataaattacttacttttacttactcatgtgaattaatttgaactcacattccctaaccttcaagcaatagctttttatatgttgaaatatactcttttttggagagtgaaagaagtaatattttgaagctgaagtaactgatttttccacattaacaacaaaaaatagttggaaaaaagaaatgactgccaacacagaaagccctacttttaaaagcatttattgtaaaacataatatctagaagatagatatttttattgaagcattcatccttaagtcattatatttggttatattaattatgtgtctacagatgctgcaattgatgagacaataagagaagatatatttcagatataaactacatgcttaggtatattcatatcatcagtgattatagagatctgtttgcagtgctttatgcatatggataagacagtataaagaattgtgatgacaaatgacatatttctccatctagacttatctttttatttaatattttagccaaggatttttttattttctaataactttctgactgaggagttattactgctggcagcagcagtacccacaggatgcacatacctgtctgctaaaaggcacaatcatatacttttcagactttaattacgcttatactgcaatccaaatttatgatcttgtcctacagtctccttagttttttgttaatatttctagtaagtccttcctctagcctgatctcattgtaatagaaaatatccactaaaaaatagaagagttattcttatctatattgaccaataataagaccacaaagatacagttaactttaaaaatacaaatttgatatcaaaattgaaatttggttatttcacaagtgatactgggaaagggaagctggagaattctggctcaaataatgtaaattgttaagcagtctattcgacaacaacgaaggaagaggaatatttttggaaggagggcattcagtgtgcagtgtgcctgcagagtcttaccttcgagcatcattgtggtaggaagaagggagagtgtgagtcattctgagggctctaggggtaggaggaggagaagtttcacatttaattgttgctttgtcctctcgaccatcttcttccacaactgcaatctagaagcaaaaacaatacattcaaataaaccctttctaaatttcagttgaaattgacacaaatggagaatcatgagaacaaggctgtcgagtaattttaatacaaaataaaacaacaaaacttggggcatttaagtcttacatacataaattcccattaaagagtttgattttcacaaatatttaaattggacacattaaaattaaaaaaaaatcatagacccactacacaaaaatgtttgattaataaacaccatagatcaagcttttccaacccacagcctgctggaaacatatagcccaagacggctttgaatgcagcccaacacgaattcgtaaactgtcttaaaacgatttatgcacggaccttttttttaaagttcattagctatcattagtgttagagtagtttatgtgtggcccaagacaattcttcttctaatgtagcccagggaagccaaaagattagacactgctgccataaatcaactagttgctgactattgatctatagtgtttattgacattgatctatgatattttataacatcagaatataaactctttacaaaaaggtattaaacacacatttgaacaattcactaacatatagcattatacatactcaggctatcataataaagacatcttttaagtagggatttttgaaatgagaagttgataaaatataactttatcagataaagtgttttaaatcagtcagcctaatgaaatttattacagggtatttaaaatatgagttgtggtttgtaagaaaaaaatctctttttaaagagaataataaaaggtaagatagtaatgttttcaaattgttccattttactaccatgatgggaaaactggcaaagacatacagaaaaccaaaagaagatgagatgggagggatttccttaaagaacactttagtacagaatccagaatgactcaggatactatccattttgtcagagatgaagatatagagctgtaacttaaaattttttccaatgtcaagttaattgtagagacatagtttttacaacaatgctgcatatttttcatggcatcgttgtgtatcacaatatggagagatcaggattgtagaaaacacagctaaagacttatggctttagagttctgatgaaaaaagttcttagtatggctaaacaaaaatttttaaagttctagggaaatattttgtttgtttttatgtaaagctgttatttataaatgtgtttatctataataaagaccttgtaactttgaggaacttcatgaaattgtcaggacttttgtcacccaatcttaggttccttttaacagcttaggtaggtaggcatttttatataattcctttgctctattcaactagcatattgccatcaggagaatcttttttcaataactgctttcggattgattctgatgctgtggaaaacctttttaaacccacaacccagctaaactcttaagcgtgtttctgaactattcctaatacatgttagtgttttcacagttctgtgatcccaccatgactcttctctgattgtttctgctaagcatggccatttttgctgtcagaattttgcttctgaaacatcttataaaataccctctttgtcctccctgccagccaaactatacttattcccaataacagcttctaaaaacagcatggcacatgtatacatatgtaactaaccggcacattgtgcacatgtaccctaaaacttaaagtataataataataataataataataataataataaatcatgtacaaaactttcctctgaatatcacttagagttttggaattagagagggatttgaattctgatttttcttaaatgttgaataaataggctgattacttacctgctctaatattacatttcctcatcaataaaatggaagtgatacaacacttttcttaatgtagtcttttgaagtgtaaataccatcatttatttaactcgttccccgatacacaagatttttttggttgtggtccctctttccatgacttttctcacaaattatgttgttacttcctgaattatttgagactacattttcgtatagaaccttccatcctacctttctatttcttacagccattaaacttatatagtctttttaaggtgatggaggtcaaagaaaataaggacattatacttggtaaatttggtaaataagaatgaactggtagtgttaaggagaagaggctataggtagatagataatagcccaggaaaataaaatggtaattccatctattcaagccatgtaagaataatatagattcctttattttttttaaaaaaaggacataaaagttatctggttccaggagtgttccaatgtttgggtgtaagctgactaccacatctcgaagatgctgaggaatagatttttgcactgaatagaagtttgaatctttgaaatctttttcatctgatgtcccatgagtgaaagctctactcaattatctaataagatgtcattttgtgaatcagaacttcagttcattttgttttccatattccatatttattctcttgatttcattccaaacagaaaagcggtgtttcgaacatatttttttattttgcatagtcttgatgctctggcatctggagaggatgctcctctaaccctagggatagttaattcctggaaatagcacatcactcacctataagtacacctttcacatgcaaaccaaacaactcacagcccatactctaaatcatcttctccatctggctcttactctccaagaggcaatattcctctgccctaatcacctgtgggccaggctgagacaactagagagagtccctacatcctgaggccagacaaaattaatcaggctatccatcctaacctgcttatcctgccttgtcttgcctttccctaagatacctcagaaaaccttctgccctgctccttctgcctcctgactgacgctggtgctgtcctgaggcacagagtactctctcctcttgggaactgtgagtaacaagctatctttttttgacagctttctcccaatctgttgtcctcaccctatcaaaataataataataaaatatttgaaaacaacgagcattatttattatatattaaatattaaaacatttgtactatattatattaataaatataaatacttatattaaaatataaaattacaccatccttggtttaaatattcaatggaaaacaggatattatggttcttataatctaattattgctccagaaatcataaacaattttatctttgaagtattttctattataatcaaatttaaacaattcaatacactttaaatactctcaactttttaatgttttatcaacattcgactagagggaatattattttaaagctttcatagaataaaacagtattcaattcgtaatgatgtaaaagttatttactgtacctttctccgatgtttcctcagatcacttggctgtgattggcagtaataaaaacataaaacacaattaattaagaattaacaatcatttgaccaagttacaattttaaatagtgtctacaacttgactatcatttttttcttcattttgttattttctaaataaacatattttaattactataaaagcactccgcctggtagttaaatttagagagggaacttctcaggtaacataagtcagatgattgtttccataatggggccatgtgtacaggcactggatacgaggcatggaccctgggaaagagaaactgtggaatgagtgagtgagtctagctagaagagtgagctagctagaaataaacgagactgcatcttttcaagaaaatattattgggagtgaagatccaatgcatatacaaggagtttataaattcttgtttttgccccatctatgcagagctttgggcctcctttgggcagatgtgctgttcctgtgggatctcaaaatttttggcatcctaaaatctttctctttcccacaaatgccaaaagcattttcttcaggttaaaaaaaattacccatattttattaaaaatatacaattgatgacagaattatattaggtgttaaggacttcctggatttcatttcttgcttctctgacttagatattaaacactttaaatatttctttactcttctaaaaatgccttttttttcagtactctaattataatgtaataatattcatattccactgatttatttattactaattgttcaagagaattcatgaaagcactggcatctttctctctctctctgtctctcacacacacacacaatcacatctaaaggattataaatattttattgctatgaaagtaatagcactatcaagagttatgatgcttatgtttataaaaagacttaaaagtgtaaaactgtgttgtaaaaatgtcagaaataaaagcaatacaaaaataatcaaagtattcctgccttgaatgctgactaaattttattctgtggtccaggattcttactataggtttggtactaagttgctcattaatactatgtagcatatcttatataggcagaaactaagcaagagacaataacacttttaactaacaaaatcagatgaatggttcctaaatttctaaaataagcagatcacaatgtagttccgtatgtttggttagtatatctcagcacattggctaaaagtttgtactgtatccaagtggaatcagttctgattagctgggcattttttctggttggccattgtctattctatttaaaaaacatttttagtaggaagttttggaaatgagcagaaaatagtggactcagcagcttaaagaggtaactgtcttctttttaaaaaaaattcacaatttttcttttacataagttttatggcttggaagcctcaaaattgtaagtatgccaatgcatattcactacaaaaacataattttacctccataaacagttcagaatgttttaatcttcatcattggtgtcatttcaacatactatatttctaggtaatgactgaaacagaaagacatggtagtacatgcttttaaattaggcaaatttgtggaaaaatccagctccatttattagctgtgttgaatatgggcactccatttatactctcaaaacctccactctctgttgagataatgccctactacctccagttttgccacgagaattaaatgactaacatcatggtattcagcagtcatcacaatcatattttccagaggttttattatatataaatatatataatgaaatatattttataatgaaatacatatattacatattaatatatttttataataaaattttttagaatggggaaatttgactttttctcagttgcattcaggagacttcctaatttaggcttccatcttctaatcccaaatataaagataaatgaaataaggaattaatgtatacatgtgaaaatgtgaatataaaatctaaaacaaaattaggaattagtagctgttgttttttatggctcttaacacaaataatgcaagaaatttatgttatatattgaaaagttataaaactctatcttggtgtattgaagcaattataatactaagttttgttacttattatgttaaaaacacacacacacagagtccaaagtgatttcctccgtatgccatcaataaaaatgtacttaatggtttaagtcattcaatttttaaaaaaaaattattttattttatttttttcaagaaggaatctcactctgttgcccaggctggagtgcagtgttgccatgatagctcactgcagtctcaaattcctaggctcaaggaatcctgctgcctcagtatcctaagtagcagtgactacaggtacagaccaccaccacacccagctaatttttttctttttctctttttcttttctttttttttgagatgcggtcttgctatgtttcttaggctagtcttgaaatccttgcctctaggtaatcctcctgcctcagcctccaaaagcgctaggattatagctgtgagccactatgcccagaaattcattgacatttataatgtgctatttagatctctgctctaccattgacttactatttgacccttagaaagttacagcacctgtgtgggttaccatttcttcatctcataatgggattcataaatgtactgatcacatagggatgttgtgaataagaaaataaataaacaataaaatacacagaaagtacttagactagaacaaacacccagttaagttttagctaaagcatcattaatcttaacaggaggcaaaggttctctggacacatcaccataccagtgtcatgactcccatccgatccatttccctggcagggcttcgaggggtgagctttggagttgagtgtccactggggggagatgaactggccagcgatgaagctgtaacagaggcagtaatggaggtacctgggtggacccttgccaaattcaggccttcgaggctcacactagccactctattttcaatttcttcagcacgcaactctgtagattctttttcttcctgaattagcctgaaagatacagtttaattatgatccatatataatttaatatggatccattatatgctgctgtaaggatcattggaattcacataataaatcagtagaaactattcttgaacattttacatcaaatctaattttttcatcttttttttttctctaaatagtgtaacttgcagtaaattccagggacttcctggctgcagtttagaaaattgttttcaaatgatacattttttcctgacaacttccagttttaccttctttgtatactaccacctgctaaaactatttaaaaatcttgaacctaattaatttctaccattaatcctaatcttacatttgacctcaggaaccactaaaagagactttagaaactcagccttgagatggcaaaggactagcaatagcttagaaaaagtgaaagattataattacatgtaaatatccctcttaagattcaaagtcattgaatcttacctcctacctaatgaaaaagtttaaatgatagtatcctcagtaaatggtcattcataattagccaaataaaaccctgagtcttttcttaatattaatacttagccaagcctcctttaaataagtaccagaaaaggtaataatgtgaaaatatagttatatagatagatgatgaatacataaataatgaaaaagtaacttgcaaataaaactaggccaggagtggtggctcacgcctgtaatcccagcactttgggaggccgagatgggtggatcatgaggtcaggagttcgagaccagcctggccaatatggtgaaaccccgtctctactaaaaatacaaaaatcagccaggcatggtggtgcatgcctgtaatcccagctactcgggaggctgaagcaggagaatcgcttgaacccgggaggcagagtttgcagtgagccgagatagcgccactgcactccagcctgggtggcagagtgagaaaaaaaattatataaattatttattacaaaggcacaaataggaaagagctttagctaggttgtgtaaaaatcctatttgaatcctgaattaaatctatacacattttgtatgttgttataatgaaactgtgtaccagtatagtttgataagggggtcgtaaaattctcctgagctattttgttcttgattacaaatggtttattgggatcccctcttatatagaacctgtaccttcaagtttatgatcacttcaaagttttctttttacatatttagaatggagaatgtaatttatttgctaaatttattcgctaaatttattcaataggaaatacttctctggtgtacgtttactatgggaagttgagctacatttactcacctgtttttatatgttcaccagctctttgattattaactcactgctggtgtcttcactaactattctgcaaatctttcagtttttaagtagtatgtgtttgctggccaggcagaaagtactttggtagtctacttacatgtcattggaataagtgatctttgtgattttaataggctgtttaaaaatcttacaaagtatggacttaaaatctaatcaaatatgtttcacaaaggttcattttggttaaaacattatgaggcacatttacacttaattataatctttcacttagaaaaagaacatgaattctgttactctcaaagtttattttcatgaatgcattttttaacttcaccccaaggtcagaactccaaagaaaggtttaatcaagtaacatagtacatagtaacatagcttaacacacatttgaaagaaaaaactatcttcaccctcaaaaaataaaaatgtaaaaaaaagaagacattttgtacttttaaaatacttagtagaaaaatgactcctagaaatttttttctggtgagatgtaacatggttatgctgtacacagaaattttggttattaactttaggtattctataaattgtacaagacagccaaacctagaggaacaagttgggtaagagagtatattgaagtttaatttaacagacaatagtagctaactataaaagcacagatgaatgaacattgctgtggcaaatgagtttgaagtaatttgaatcagcgagctgtgaagacagaaaacatgcattttttaatggctagattagtttatgaaagaagaaaaatcttaatcacagaaaaattctggttgttattagcagttcacctggtttgaatcaagatgactatttcttttaaatgtgatataatctcatttcatgtatttttaaaatcttacaaataaacaactatattaacctactggccaagattgttactagaaattactaccctaatgttacaaagctaagagtcactgaagagaaatagcttgttatggagggtgtgttgatctctttggtgcaaataaatatcacaagaatatagacttgatttcaaacttaatttggtaaattcgaccattagctgaacagcctcagaaagtgttattccgttattccgttaatacttgttttacattatttttctatttagagtaatcaaatatttatgaagcactctctaaatatcaagcgaagtgctaagacctgcaaataaaggtgagcaaagccagatacatttcttgctcctgtataaaagttacaatctagtgaaggtaaagaactgaaggacagtactacgttccttgaagaagtgatggaggagctgtccatggtgagtaagggtaacatgagtgaaatgttagggtagaagggtgtggaatgacaggaatgttccagaagaaagggatgacacaacaaaagaaagagcatggaacatcaaggaactagaaagtaggcaaggtaaatggttagagaatggtgagacaggtgaggtattgtagaccatattaaaaagtgtggttggtatcctaagaacaattgaatggttagaaaaagggggattacataaacacatttgtgtgtttaaaagtcttctctggctgtagttaggttggtatatggagaactagcatactacaaagaaaccagatagtaatggttattgtcataaggtaaaaaactattctaaagtgcagtagggtgatgataggtaatttgaataatagtagaaggaagccaactgatttagctagacccagaaagaaaaaagaaaggcattgttcaaaagacttaaaacctgttcacccattgaaaaaacaagttaagaatggtttgttgatattcagaagaacacaaatctacctgacacaattgggttcatcactggggttagtcaaggaaatgacagaaaaagctgatgtcattggaattcaagaaaccatatattaaattaaaataaaagtatcagagtgccaacatttctcaatatttgaaatgttaatttgtccaatttcaattgtaatgaaaaccatctattattagggtactatatagcaacagtacatttttttcataactagtatgaaatagttcatatcaccatatgttttattgcctttgaaatgaaaatataataaagatatttgttaggctataatattaaattatgtctcacagatatagtaagccttttatatttaaagaatgcaaatgaatttggtccccatttacttagaaaatgttcgcacatatgtccccaaaatgctaggggatttttaatgatcagcctgatttgttataaacttcagcattaatatgtgaaaaatgtattttcactgatgtaagaatattaatcataaaaaactctataagaattgtgtctcagtttaagatatggtagcagcccaacttcaaacgcaagttttaggcaccagtgaacacaattaaacagccacaagcactaagattaacaatctgaggctgggtgtggtagctcacacttgtaatttcagtattttgggaggccaaggcaggaggatcattagagcccaggagttcaagaccaccctgggcaagggagactatgtctctacaaaaaattaaaaaaaaaaaaaaaaaaaagacaggcatggtggcacatgcctatagtcccagctacttggaaggctgaggtgggagaattgcttgagactgggaggttgtgggctgcagtgagccagatctgagttatggcacactagcctgggtagcagtgtgagaccctatttaaataaaaaaaaatctgaattttcatgcaatatgttaatacagaaatgtaatttttattattaagaatagtagtaatatgtttggtttatcccatttaaaggcattaacttttattttttctcaagtgttccaggcagagaagaggactctatcctgctttctgcatttgctttgctatgaactgaattttatctcccaccttcaattcataggccgaagctgtaaaggccaaagtgactgtatttgaaaataggatctggaggaggtaattgaggttacatgaggtcttccataaatctttctttagtaaaggctctcagatcccttaaaagtatttaaaaattggagtgaaattaatttgctcttctgacaagttcaagatcaaggttccagcaggattctgtttttggtaaaggctctctgttcctggctccaggaaaagggaaaggtgggtgggcagtggggggcagacagagagagagagagagagagaggcttaattctatagaattaatatattaatgttctatctctctctctccccccactgtctttctgcctcccactgcctgcctcactttccctttccctggagccaggaagagagcctttaccaaaaactgaaccctgctgataccttcatcttggaccttccagcctctaaaactgttaatgttaataaacttccaagaaacacgctgtccctgatataaatggcataaaattgacaaaaagaatggtaaattaatttcactccaatgttgaaatattttaaggaatctgaatgcacattaatttgcatactatttggtacctttattgcagtatgtaatgtatctgaagaatgtacgtgattaccacacacactttccctttaagtagtaaattttaatttaaaaagtgctttaaaattcactggagaaagttttgcctttaacttattcttctgtactgtcactgatgtcattaatcttatatgtttcatgtatgttccttacaaaggctgtcctaatattataaaggagatatacaatatcctgggaatcttctgaaaatacacattctgattcagtgtgtacggggtgaggtctgagattctgcagatctattaagctcccagttaatgctaatgcttctgatctagtaattacatttttagtacagtatcaaggtcttctaatttcttgaaatcatcagtactaattgaagttacctgatttctttgttgatggcatccaattgttcctgaagcatcatggctagcgtctgggcatcggaatgaccacttggagagagaagatccattgagctaaaaattgtttctctgtcatcatcatcaatatcagacatttcagtgtcactttcaaaagggtggctgcttagtactccaatctgttgagttctattccactcgtgatccccaagagatttcacctgaatggtgaatgaaaaaatgcagaatatttatcatattgctcattttcaaagcattaatctcaaagacagcaacaacaacaggcatgcttttacaactgaccttgcaaaaactgaaccaattattaacattttaatttatttgcttccataaaatagttccttgacatcttaagtaatgtgagggattgtcagtataaatatcaagattttagtagaaataaagatgataaacttctatatgttttatagttcaatcatattccaaggtaacaattactttaaagcatgtatttgtaatacttttccttatttccaaatataacaatctatttatttgtactcaagcactcacgacttaaactaattagtcttcctatattttcttattataagctcagaccacaaatattatcacataagaaattacacaggaattctcttcccaacatttatttacatcgattctaacaaaatattatttaaaatattgcaaaatgatgtacaggtatactccacagagatttcagggttagttccagcccaccctgataaagtgaatatgacattagagtcacacaaatttattggtttcccaatgaatatgaaagttatgcccattctctactgaagtctattaagtgtataattgcactgtgtctaaaaaatgaacataccttcattaaaaatactttatagctaaaaaatgctaatgatcatctgagccttcagtgagttttaatctttttgctggtggaaggtcttgccttgatgctgatggctgctgactgataagggtaatggttactgaaggttgggtggctgtgacaatttttaaacataagacaacaatgaaatttgccacattgattgactctttctttcatgaaagatttctctgtagcatggaatgcagtttgatagcatttaacccagagtagaacttctttcaaaatcggaatcaatcctctcacaccctgaaactgtcttatcaactgtgtaatctaatattttatatcctttgttgtcattttaacaatgttcaccaagagtagttaccatcttcactgggagtagattccatctcaagaaaccactttctgttcattcataaaaagtaaatcctcatctgttcaagttttatcatgagattgcagcaatttggtttcgttttcaggctctacttctaattctagttctcttgttattttcaccacatttgcagttatttcctccacagaagtattgagcccttcaaagtcatccatgagggttaaaatcaatgtcttcttaactcttattaaggttgattttttttttttgagagggagtcttgctctgttgcccaggctggagggcagcggcttgatctcggctcactgcaacctctgccacccgagctcaagctattctcatgcctcagccttcagagtagctaggaatgcagaggtgcacaaccacacccagctaatttttgtacttttagtagagatgagatttcaccatgttggccaggctggtctcgagctcctgacttcaggtgatcacctgcctcagcctctcaaagtgctgggattacaggtgtgagccattgaacctgatcaaggttgatgttttgaccttctcccatgagtcataaatgttcttaatggcgcctagaatgatgaatcgtttccagaatgttttcaattggctttgccccaatccatcagaggagtcactacctatggcagttatagccctgtgaaatgtatttcttaagttataatacttgaaagccaaaattactgctttatccacgggctacagaatgaatgttgtgttagcaggcacgaaaaaaacaatctctttgagcatctctgtcagagctcttgggtggccaggtgcattgttaataagtagtaatattttgaaaggagtatttttttctgagcagtaagtctcaaatctgtgtttaaaatattcagtaaaccatgctgtaaacaaatgtgctgtcatctaggctttgttgttgcattcatagagcacaggtagagtagatttagcagaattcttgaagaccctaggattttcagcatagtgaatgagcattggcttcagcttacagtcactagctgcattcattcacccctgtcctctgagtctttgaagccagtcatttacttttcttctctatatatgaaagtcctagctggcatcttcttccaatggaaggtggtttcatctacattgaaaacccatcgtttagtgtagtcatcctcatgaattatcgtagctagatcttctgaataacttttaacagcttctccatcagcccttgttgcttcaccttgcacttttatgttgtgaagatggcttccttccttaaactttatgaactgaacaaccctctgctagcttcaaagttttcttctgcagcttcctcacctctctcagtcttcatataaatgaggagagttatggtcttgctctgggttatgctttggtttaagggaatgttgtccatgctttgattgtttatcactaaatgatcaaatttacgtagaccactaaaacgttctccatagcagcagtaaggctgttttgttttcttacttgcgtgttgtttcttattttccttcaggaacttttcctttgtagtcacaacttggctgtttgatgccagaggcctagcttttggcttaactcagcttttgacatgtctttctcactaactttaattgttgctagcttttgacttagtgagagatgtgcaactcttactttcacttgaacacttaaggctattgtagggttattaattgatctactttcaatattgttgtgtcttggggaatacaaaggcccaaagaaagggaaagcagtgggaaatggctgttggagcagaagcacacacaacatatagattaacttcactatcttatattggcatggttcatggtgtacccaaatgattacaatagtgacatcaaagatcactgttcacagatcaccataacagatataataataataataaaagtttgaaatatttcgagaactggtaggtgcagtggttcacgcttataatcccagcactttgggaggctgaggtgggcagatcacttgagcacaggagtttgagatcaacctgggcaagatggtgaaatcccatcactacaaaaaatacaaaaattagctgggcatagtggtgcccgcttgtggtcccagctacttgggaggctgagatgggaggattgcttgagctcaggaattcaaggctgcaatgagccatgatcgtgccactgcactccagcctgggtgacagaataataccctgtctcaaaaaaataaaaaaaaagaaatattgtgaaaattgccaaaatatgagacagatataggaaatgagcacatgcattgaaaaactagcatccatagacttgcttgaggcaaggttatcaggaaccttcaatttgtaaaaaactgacaaacaaacaaacataatgcttgtgaaatacaataaagcaaagcacagtaaaacaaggtatacctgtaatttttaagcccaaggcatgctaatttacatggttatgttttttaaatggatacaagaaatcttccatttgaagtaagcaattgaccagtgtttttcaagctgttatctgaatgtatgaggaggctgagcataaaagacagatcctagatctcttttattctgcttcttaaaaaattggtttttatttttgtgatcatataaaatgatttctatggaagaccacatgatacttccctgagcattgagttaagaattgagaaccagaattagtatttgtgttacaatttgttttggtatcaagtagcactaattaatttgtcacataataatgagaaaagaattgagattaacttaatttagtcttcatttgctcatttatttattcatgtattcaacagatattgaatgcctactatgatggattaattaatacatggcatactggtgccagttcaaacccaaaagtcatcaagggcctgtgtacaaatatggacaaatggattatatagtatttggggtgaataaaagtggttgaaagaataaactatgcttaggcaccaaaggactattttacttctctgtaaaatacaactacattattcaacaaacagcttgcaaattttaaattaagttactgactgaatggaaggctagcactgccccttatcattaatagttctttatgaacacaaggaatagtctatgtacattttcttcaaagtgtttttaaaataccaattttaattaagttaatttgaatgaacaacatgaatgccattgctcaagtgcccaagaaaatcaaaagactacatgtttggcaatgtagcataatagttaatattacactactaatagtactggaaactacacaaacataggcccaagttttgactccattactttgctacctgtgcaatgttgaacatttagcttttctgagcctcagtgtttttatgtctgaacttagtatacaagtagtacccacttcataatgttatatgaataaatacatgggaaatgcttattcaactttgggcccatagtaggggctttatgttacttatagtttttttaaaaatgtcatactctgtgtttcaaattaataaaaatgctagcattttctaattatctcagtgttaaaattctatcaaaaatgaaactatgtatttaaataaaactagagaagagttgaagttaaaagattaacctttggctcatctcttcgcacacccatgcggcctctccttggtcttcttattactttagttgttctgtaatcagactggctgtccactagggatcccactgagtaccgcaactcagctgaggtgtctagatgagttctggaaaaaaggaaaaatataaaataatccaatctcaaaaattaaacttaccaggaaattactatctgctgttttactggcaataaagcagaaatcctcaaggaaataaacctcaagaaagataaccgataaattgtcatgactctctgaggcctctttagagacttatgtcagaagctgcagtcttaggtccattcctgaaagtcaagtgcactttcttcttttagaatatacagtgcttataacctttctgtttattatcattttcaaatgcagtagtaaaatgaatcataataagactgataatcaaaatccattaggttaaattctggcaatttagtttgagctcttttgtgtatatcacagtatgtgctattgattactgtatttgttttaaatatttcttatacatctagctaaaaatgtctgaaatttgagggtcccagaacttttccaatcttaaaatttttggagaaatttattcacattgtctatttttcacattctatttttcaatttagagaatcaacaaaatgcttaaatttagatggacccaaggcttatggtcttatttttataaaagaaaataggatatactaccaaaaggattttttaagtttttaataagacattgtttcaaaaggatgaagaaaaatcttttcataagcacatttgattcttaaatctgcttaaagatgaaagagtcggaaaattttagttggaaagtatcattacactagttttcaataaacatggtaataaagtaccctataatcaaagtgcagaaaaggcttctccaggcatattacttatatgtagatttatagcaaattcattttattgttacaataatgatgataataacagtgacataatgctgtcctataaaatgaaataacagatctatcatcagtaggaaatatacttaaagctgttagttctattgaatttgaggctcctgctgattgactatactctctttttcagttattcttgtgaacaaagacaagcacttccaaatatctggtaacattaaaaaggggaggtgaggtttgggtgtttgcaacagcagaagacactaacttaagaaagttcttgttttgccaaatggggcattagaacaaatgaactaaaacattttccatcaaataggtgacagctattgtttttgtagcaatgtatttgagacttaatcaagtaaacaggttttatcatggataagttacatttaaaaaaaaaaacaactaggccatattcataaaggacacaactctgtctttatctcttgggcagaggctctaagtttcatgaagaacaaagatcagattttagtcaccttcctatgtccaggaaggcgttcctagcatataataagcacttcataaatatctggcaagatgataaataaaagaaatgattataagacaggcttaaactgtcttgttgtgatcagtctgggttcctttttcctgtggctgcttaccttaatgtccctttaggcatcagggtgaagtttctaacattataactcatcatcctaggagcattgttttcttgttgatttatttcacagctccagataatttattttaaaaaaaagcaaaacacagatctaatcatatcaatttcctgcttaaaattattcaatgtccttaaaggccctctataacttgggcctttgccactttccagtttcattttaaggtactctctgcctagcttttcatacagctgtactgaccttctttcaattccagtaactcacactttcttttcatttctttgaacatgcttttgtttttgtttgtttgtttgtgttctcctgaaaacagtctcaacacatgtggttaacagttttaaggtctcagtttaaaagtgctattgccatctacccttctagctcctagtattcttttttattgtaccagtcctcaaactcatctctctcctcttttttccagttctctgagctagttctctaacaggagaaaacagaggcaatattatcatactagttcaatttttaaatcattctaggtgttcagtattttgaaaggcttttggaaggtctaagtaagtcacaaaataggcatcagttcctttaagcaatgaaccctgtagcttctcctcctgaatctcctgtgactcttgcatgtaatctcattaaagaacttgcataaataagccaggtaagaatttttttagagaaaacctattacccatcgctctgcttcctggagtgttctctgttgtcctttccaattacccagagtctatcttttttcagagttgagccaaatcaagccctttgtagtcactctggaactcattttactttcttcttagatgagatattaagagagaagagtggtcactgatattcactcaccttagcttatctctcctcacctctccacctattagatcaaaacttagtagactgagttctcatgcacctcctatttccattattgtttttacgaaattacttgtcctcagaagcatgaatgttctataaataattgttgtttaataaatattcagttatcctgtaacttattataataagttctgtttagctagcttaccttaattatttctataatactttatacttgtgatatgatttactatacatataatccctactgcttgtcttattttatctgcaaaccaagcctgtgatataatcagaaaaatatcatttatgcatatttaggtacaaatatgtatttatttagaatgttattaaggaaaacaggtttccaaaatgaagcagcttgtaattatctgtgagtcctaggaatgtggattgtcttattcttggtctagggttccttccactacaatctgttgatcaaagaataattgttctatataggccaaatcatccttcattgtagataaatgtcacattgttaggctgcccataatgactcagtgcagtgatagacttttagacaacactttgaaactctgtattttgagacataaggtcaaaaaaacaaggaaatggccatttattcttaatcaaatatatttaatctattgatttgataatgcttattctatgcattgactcccctgatattttaccagttcttctccttctccttctccaccatcctcattataatcatcataaccatgtgaacacataacattgaaataataatttcagttcacatgtaaaaatcagaatcttaaaaatgtgaaaaataagaacgattttctcaattaatgacttacatatgtaaaagttctttgagtgtttttatgcctgccgaactttttctcatattcaattgagtatggaagtacttaaaatatcaaatattgtttttccttacatttatattgaaaagaatttaagacacttcaggattttttcaatttgaatttttatttgagaatctgaaaaatgctttaccagatattcatttattcattctataatatatcttgagagcatactatatgcaagatagttttttaggtgttgagattatggtagttatcaaaacaaatacaaacccatcctctggtggagttaactttctaaagatgaacataacaccaagaaagatgaacttctactaaaagcctatggtagtggaaagtttcaaacggctgctattattctgtgttgcctagtaaataagtgactaaatgagtgtgtccttctagggtttctaacaactttaaataaaacatctcaaacacaaaaggaaattatgtgtgaattattaacatatagatctatctatgtatctatctatgtatctatgtatctatctatctatctatctatctatctatctatctatctatctatgatctatcaagtaagctgccatccattgcttctttttcttaagatgagatagtgaatcaaagtagatgagtatggctaaatttatttgaagtttttgttttcttttcttttatctgattcatttctcttttcctcttttttttttttgcaattactttaccgaaataggtagatgctaagtgaccataatcaataatatttgtttagtcacataagcattgaacatatttctgcatgtttctacactgaacacatatagaaaattttatgtcgaattcaatttctgtattgaacacatataaagagaagggctgacgcctcttcttgaatgagatgcaatctccctgtacacagttcaatttcttcaattaagaatcttttaatatatttatatatataatgaaatgcagaatacaaaagttaacattttaattttttattgattatctacagaaataatctctaagttaaaaagttatttttgaatgtaaaaactgcaaatcagtgaagagtcaaaacatgataatgactagtgagcaataggaagtactgatttattttagttgaggacatatgaaaccataagggaattcatgttgattttcagtgaattatagataagcttttagtttaatgttaccttggtattgtgggttcaattaaagagccagttctcattttcaattggtcaagttcagatctcagcttttcaatttcttctgctaatctttcctaaaaaatcaaaacagtgttactcagatgccagtaatatcagcaagcaattatgataaatgagtcttaatgattttttttaaaaaggaaaaactgaggatatatttttattaaaggttattacacataataataaagcacgccaaaattttccccttgtaataaaaaatgtggatagcagaaattaataaaaatttatctacaatctctggcattcactaatcctgaatatttgaaaattcgtgggaatattaaaattatgactagctatgtagatgtcacttaaaaatgcagagtagaaatcatatgcagttttgaaaataaagaaaatgtcttatttatgcagtaaatgaagaactttcattattctatgagggttaaaggacatatgggtgaaggaaaaagatgattggattgaaagaaaaaggaaagtaaaccctctggcttttactctgcatgagataggcaacaattggaggatttttttaaaaaatattaattaattaattaatttatttatttatttaaagacagggcctcactctgtcactgaggctggagtgcaccttaaaaagtaaagttaataaccaattagcttgatattgtcaccattatttgtacttaattataattttctcaaattggcattttctggtctataaatttatgaagataggggttgtcttagagctttaattaactgctcatgtaagcattcaatttggttttaatgattataactgttatattgttttacaggtctaaatgtatcattctagatttttctattactgtttttccccttcccagtggccagtgcttgatattttactttactcaaacttttctcaccacatttttttttgttaatgtggcctttgcaatgtttctcttttctgttctttttattctcactacgtcactaccatcctactctaagccctttttatctttttcctgaatgatttttaccagcttcagtctctttcctacacatttctctgctagacatataatttcaaaacacatgtacaataaactaatgtgttgctttaaaatgttcaatagtttcttattgatttgtaaatatctttgttcattattttcacaaaagtgcgctgagtacctcttgtgtgtcaggcacctgagatacagtagtgagctgacaaatgtcttgccctcatgcaatttagaatttagtagaaaagatgaataataaacaagtagtaatatagaaatatagcatgttgttagaaaggagaaaacaggggagtcatggaagggtttttcaataaagtgatacttggacaatgacctaaataaaggagaaattaaaaaatgagactcttaggaaaaggcatggcagataaaagcaacaacacgtgcatacgcctcttagtggaaatggagtagagggtaaggagtccagtgtggctggattgcagaggttaaattgacaaatagaggatactttttaaaagtatgattgcagaactcaggaatggtagtcctaaaagaggttgtaaaccacttcaaactctggcttttactctgcatgagataggcaacaattgaaggattttaaaaaattattttatttatgtatttatttatttaaagacagggtctcactttgccactgaaactggagtgcagttctgtgatcacagttcattgcagtcttgaactccagggctcaagtaatcctcttgcctctgccttccaagtagttaggaggactacaggtgtgcaccactgcacctggctaatttgtttttaatttttatttttgtaaagatggggtcttgctatgtttcctggattttctagcagagaagtggcatgatcattctaatggctgtgaaatagattgtcaagttgaattgggagtcagaaaagagaggaaattttgaggcaagagagtaatggtttggacaagaatggtgttagggtaagagtggctatattttggctatatcgtgagagtagaaataagaggatttgatattggactagatgtgggatatgaaacaaacataggggtcaagactaagtccaagttttttagcctgagtaactgaaagaaagaaagaaattgtaattatgattgactgagaagactgctggtgtgttaggttagatggtggtggtgtttgatgtgtgggagtggggtgagaatagactggcatgttacatttgaggtacctaggtgtccaaatggagatattgagttggcaatagaatatataaactctctcagggaagaggacccagtaggtaatctaaatttggatgtgctcaatttatagatggtgtttaaatccaggagatcagatgaagtcactaggggtgaatcagagagaagaaaggaaagctacctagaaacttcaaattgtagagataaagatggaaagggaaacactgagaaaagagtttgagcctacagagggttttgctgataatggactgtgagtacagttagtttagtggaaatttgaggaattatagaagatgtggtcagattagtgaatgtgcccatctaaatgggatgatagttcagacatgagatatgatctgggatttactctctctggagactgacataagcaaggatgcaaagcatggcatgattagtactcttggttgcttaggcagattgttggagttacaaggctttggtaggtggtgggggagtgggttctggggatattgccaggagcacacagagctttggataacataacatgcataacagcatcacgtccaaaattcacaatctgctcaaaaactacttctttaaatacataccagtcacagtaaacttctgatgattcatcaaatcaatcatcttgattttctttgtgccgttgcagaggattcatcctctacttagaatgctctacctttatgaagatcatatatgtctttaagaggctactaaaaatgtaatctctgtgttgtttttgtgaactacctcagaaagaatcagatactatattctaggccccacattacattgttctaaagacctatctttcaggagattgtggacaccttgactgtagaattagttatttttaattgcttcataatatgcagcatccagtagggttaaatgtataattgttctctttcctctattcttcatcttttccaataccttctatatcccatactatccctccctccctccctccctcccttccttccttccttccttccttccttccttccttccttccttccttccctccctccctcttccctttccttcccttcccttccctcccttctttcttccccctctcccttctttccttcattctctttttcccttccttctctctctccatttcttctatcttttctcaacatacagttatagatcacttcttaagttagcaatcctttcttctttaaaaaaataagataaaattgctaacaataactttaaaggctaatgaagaaggaaaatactattagcaattaccattaaaatttcacaatctgcccttagtttcctcttctaccacataccctacaacaggaataattgattccagccaaatagttgtgcctattatttaaaatgtcacactcattacccatcccctcaccccaccaagcacctgtgatcatgccacatgcactatgtttgaaagcctggggtcagagtcctactttcccttaaatcttcagtcaagtccctccttcctgaagtcttcttcacagcagcaatatatcatggtctttcctacctgtagctcttactgcctacttcactaatttggcatttggcatctgctaccctgcatcctcattggtttgtaagggctgtgttctctctcctcagttagatttttttagctcctttggaactaggattatgtttggacatatataacttagcataattctatttataatagtatttaatgtatttctgctgaaagaatatctaaaactgacataaattagcgcatatattttaattctatttatataaggcataaagcaaggcaaaaccattttttaatgttataagtcaagatagtgattatcctttaatggaagagtatgagtatagactaatttggggggagtttctgaagtgctaatttttggtgaatttgggttacaaagattcatgaagctcttcctctctatgtacgcttttctgcacatattctaaaaagttaaaattgttttacaaagatagcatactaaaattattttttcaaatttattttacaacaaaacattcatcagtggaatagaaaataaaaatagaaaatgggcccaaaacataagtttccattataccttatcatgtaaagattcttcaagattctttctgaaagtttctgattcttgaattaaaacattctaaagaaaagaaaatagcagaaataattaataaattaaacataaaatacttaaaaatatattgattaatatcttatcactcaagaatcctcttagattccttccttagttcaggtatttcttggtttccatggaaaccatgctttgatgaaattttcaaatgtgagaccttcacatttaaaaaatacataatttaaatgggaaatgctattttgtaacacttgaatgaacaaatgaaataaatattgcattttaagctacttctgtttgccttttctcagaccacattttaaatcagaaactattggttattcttcaagtaagaaaaagtgagcaacaagctaaatcttagaggtgttataaaaaattcagaagaactcacttctattgtctgaagaaagaagaaatcatgaaatcatattttttaaaatttcactttctggacatctactgcaatgtggaattaacaatttataatgatacttaaattattagagaaataacaaactctagctattcagaaacctaatattacatgtcacaaagtcagtggaaataagttggcatcatagatacttaaaataaaccttgccagaaaattatttttgttgttaaaaattatttatttttctacaaaacacacaagtactataagacattatttaaaataatgtattctttttcaaagttatagaataaaattaaactaagagtgtagtaattgcataggggccatgtatttgaagttgtatgagaggaagtcatgtcttattactttctaatgggtaaattaatcaaactaactttttgtcaaaacattttccctattttggtttattttatgtactaatggaaaatgtctagctaaaatagtgattggcattcaatctagatttctaaaatgatgtgatcatccgggttttataccctaccttaatttatgctctggaattggtaaccagctctcataactcttgctggtctggtagctgccaactatcaatgagacatatataactgtaaatcacattgcagactgtacagaagcactatttctgaaataatgcagctgaaaatactgggttcctaaaccctctactgggattgatactagttcttttgatgatataaactcacttacattttgacttttagactggtgtgtaggtatcagtcacttgacacgtgaatatttcaaatcaccttccccccaaaaaagtattgacttgtgtctcatcacttttctattttgcataccaggcaaaggatatataaaatattttcatcataaaagcacagcatattttaatacatttgcctcatatgaacatgtgaatataaaagatttatatatcatgcaaattttttattcatcccaaatttgatcttacacttttttaaataaaaaatatgcattcctttctaagaatataccaggcatttttaaaaactaagtaaatggatcatctgaccattacaatgattgcagctgtatataaaacaaacatgagcattgcaaaatattcatgtgattttacccttctatcgttttaccttttcttctagagcagccattctttcctttaagtgtagttgtaggcgttcattggattcagtcagaagtctatcaaccgtatccgataatctcttgttatgctcctcattcattttctctctttgcctagccttacattttaaaaaatgacataaaaatccattcaaaaactgtttgagattatttttatagtgttgctagttttaaattgaatttaattttacatctgttttgattaaagtggtggaaacattttattcaagtcaacaggtcatatttgtaagttttaaatataacccatactcagttaaaggctttcttcttatatacagaatacgaattcataaaccaatgattggggggtaatagttcttaatatacatactctttgaagttcttgattcttctcttcaagttgaccctctaaatgtctcatacgttcttcaatatttccatgtctctcttcagcctgttaagaaatatgaagaatacacctgaaatgtaagatttggttaacacttttcctctaaataaattgaaataaaatgtaaagcaagctactaccaactgcaaacatagtttttaaaaaataaactttcttcaaacaggcagctgaacagcattgcttgaaatgtgtcagctacaaaggcctgttacatccaagcatcagcaaaacattggagttatttatgagcaatgaaatcagccaaatgtaacatgcagactgtgcatggtttgaacacaaacctgccattgtccaatcttaagctcctgaagcactgaactgcacagatggttgattatcaataaataaaagtaacataatttttataaatgaaaagaaaaacttagatggattctatttagcaatagaaagtaaagtccagtaggactaccttcctacgtatggagatcatttcttgtagtttagcttccataacatattgataatcatcagatgaggtagaagaggttggatcagactaacgagtcaaggaaaaggagagggacaaaattgaaaaatcagaactaaagacactgacaccaaacagaacatagcacagaatgcttaaaagaaaagtgtgacagcaaatttaatactttaatagacagaattttatgtggaaagaactacattgatatttggtgaacacgatgcagttgatggttttaaataaaaaacaataatatactaaaataaaaagctatcaacctaagatatgaaaggttagtgatggctggcaatgaaagactactacagaatgaataaagcaactctgaaagagttatataataattggaattatgggaaaccaaacaccagaatatgtctctgatagattgttaaaagtttgtattagggtttgtttgtctatattacttaaaaataatggaaacagtagtttcacaatgttgaggaaaatgctagacaatgactcaggtgtaattaatttggaacaaaatttattctaaaccttgctctgtagaaaaaaagataaaaaaactaagcctgggggttattgtgagtagtccccaattcaagcaagattgagtttcctcagcaacaggaaaacttatgaaatgacttctggtctctgaatgcacactatggtcattggtctagaatctaatggcctactctcagatacttggtctcaaatattggtctaacggtccactctcagatattggtctagaatttaatggcttactctcagataggtttaattagaaattttaaatgaaaatgattgaaagtcctcaaattatcaattgacaacaatgctgtgagaacaagaaatcttgtttgtgactctcctaaatgacattaggggccaatcccaaactgttcctgcattgatttgttgctgtggaaacaaaatagtgcctaaagtgaataggcagcacagtttccttgtaagctcatgtttgcccagtgccaaggttagatacatgtcttggaggtgaccgtcaggttaccacaggtgcagagtgttcaacacatgtgacattgctgatagcaaaattgttagtatgttatgcaaggattacatatgaagttatatcaacattttaatcattgcaagttaagtaattattacatttaaaggactctatgtcaggactacaaatttaactccacagcatattctgtcacattttataagctcattctaaaacagtgaaactcactttatgccaatatagaactatatataaatatgtcatgcagtaactgaaaagaaatagtaacctattcatttgattcagatgcatatatactattttatgcaataaattcaaatttaatctatgaaagcaaacatttaacatttcaattctggtgtgcttatgcaaactacaattcaacatttacattttgtaaggctttccttctgatattcttattttataaatgtggaagataataaagacatgataaccaattcctttcctccaagtcgtcctcaaatttccaatttagaagctatacagagttaccatggtccccaaatgccataattttttaaataatattatttaaaaatatattttattaaaaataaaaatttaaataatattatttaaattttagagtaagtggatcaaaatgttgttgaaattatataatctaaattcataaagatatctgtgatccttcaaaattacattttaacatgcagttagtagtgtttaaattaattaggtgactgactcaagacacttgagacatgaatatttcagctgccaaaactgtgtcttcaaaaatacaagtttttagaggtctttaaaacttctagttgtttctgtttacttattaaaaacacatcaaacttaaaaagaaaaaacacacaaaacaccaaaattgtgaaaattcccttcagagaaaaaaaaagaatttggtcctgtttaaattcctattattgctgatacattttattggtactagaaataaataaaatacctcattcaagatgaattatgtccttgctaaaggaatatgcattttaattaaaaagtagatattataaatcataagactgggagcccaaagtaatctttattggttaattgcgtataaactcgccaaagcaaaacttttagttgtatccataaccattaatcaatcattctgactttctaaaagacataaataagctttgcctatacacacacacacacaaacacacacacacacacaaacacacacacacacacaaacacattagaaggagaaaaatagtttatcaaccaaagaatgcattcagacatcccatctaaataatatatactgggaccaattttcaaccaacactactgatttgcattctatgtgaaaactatagttttagcaattgttgtaaatacaaagatcacacagaaacagtctgctattttttatactccttggtgaaaaactgtttatcttagtttcactccttaatatgatataggaaaatttaaaatatactaaagttttaggatgaactacaggcagaaatggttttgagaacatgaataacctcagaaagggagaagaaattaaatttaaagagaaagacctagaaaaaagaagaaaaaaaggtgacagtaaagtagaaaaacgtatattggtgaaataaaatgtctgaggggttattaagaatatcattcaaaatataggaggaggaacccatgtttaagctaagaagaaatatttttactttagtgagtagtcaaaaggttaatgaacagaaaaagactatgatgatccataataaggaaatatcagaaacaaattgaaacagaaaaaaaaaaaaaaaacagatataaaaatagaccctaaaggtcttgagaacagagtacaagaaaaagtacaaggctgttgaaaccacaaaacttgggaaaaggaatgaaagagtgatcctcaaatgtttaaaaaaaaaaaatgacaggcaaaaggaatgtgttcaggataaaatctcagtacttaaggagctttcataatgaataaaatatggtcataatataaaaagtatatatttaaaatatgttgttgacaaagcaccagtcagaagagaaagtgataaaaaggagagtgaatcagagcatttgaagactttttggaagaattccaattttctgaaaaatgaaatcaaagaggttcagggacagtaaagggaggagaaagctgaggggagctattttttgtgcccaaggtaatattgtgcccaagatatatatatatcaacttaacagactagacaagataagaggaaaaaatataaggcacctaattccagttatttttatatattctaaatcaataattcttgggagtatttaatatagtgttttttatgtcaaatattatattttaaattgtttttattctcagtctatcaaaggttaatgtggggcagtgattttctgaattgtaaattgtgttacttgggggaaattgcagattttcttgtgttttagtcaagataatattgataattattttaagctacaattttacaaaagttatttttcttattcagtaactcatctaaccccccaaaacagtgcaattgaaaaagataactctttttgaaagtcctttatgttctttagatgaaaggcctaattatgcatatcttagtctaggttatagtcatttaagatctgtgtttgcaagaaaaaatgaaataatatgaacatgtttaaatattttttcaaattaaatgataaattaatctttatcttagaaatcacatattcctgaaattgccagagtggtttactggcatggtttgtgactacagaacgatccaaattataatcccatcttaatcagttttatccaactagttactccaacactctgtaaacaagcaactatttaaatgctctctaatcctgctctacgcagtcaaaggtttgtctttcattacctggttaattgtcctattttaaccaacaggaagatcagtccactgttcatttttaattatttgcttttttagaaaatcagatgtgtgtgtctacttcattgctgcatcaattattttgggtaaatcctaatcccgtaattttaaacttgaagtccagatacctatcatactcacttattgtagtggccttgaaaacttagcaaatattaatgattgtataaaaatataaattgtgtgattatttttgaattcatattaaatgtcaaacatgcttttagtgacaaaatgtagttttatataacttgtgacatatacatacactttgaaatgatgccatttccgtttgattgtcagaggtcagaatagttctttttaacattataatgcttgtaaaattctaaaatattcagatagttgcagaatctactggccatattatacagaaaattttgaacactcttcagcgtattattgattttaattttcagatgaaattacaactataaaactgctttctgatttttaattgttttagacctcagacttttataagtctaacttcccacttctaacaagttttatactgtagttggagaggaatcaagaagttatgatattctctatacttctaatagcaattgatgtgaagcctgttaaattgttatgtctcatataacattatcttttttgtttatctccaggattattatacaaatattaccatggaaaattaactataacaatgacatgaaattttacttgttttgttaatgtttaaataggcagggggatcatcacatttgtataacaattattcctgctggcataaatatgtatgacaagaaaaaaattgacttaataacagctcaatataatagagattaaacttaattttcataaagcctatagaaaatctttacacattccattttgattacaagtcctttctacaaatatatctaggttgaccagttgttctagtgcagtaccttggttagggctgcaattctctgagccagttcagcctctacttcaggcaaggtttcagcctttctcatggtctgctgcaacttttgttcagctagctcaagacgttcttgtaactgtctgtttttctcttccatctgaaatgggaatgggagcagagacacttaaagagtcagagtttggatagcaaacaccagtcgccaggggctttgcacttcagccatgattctagatttaaatcagccactaccacacctaaatgtgcaaagtgttgattgttgtcttgttatcatatattgcttatctgtttccttcatacatttcagcacattaaaacaatgaagaagctcttaccactggcagcaaaaaggaaagaaattactcatgagtatacattttaacaaagggaatatagctcagtactaagacatcagatataccaccgtagcaaaatattgaaaatcatggtatttagactggagttggagaggtaatgtagcatgatgatccaggctctagagataaggttgacaaacattttctgtaacaggtcagatagtaaaaatgttaggcctcctgtatcatatggcctcaatcccaaatactcaactgcgttgtagcacaaaaacagtcatagacaatgattaaatgattgggcatggctgtgttccaataagactttattaacaagagcaggcaaccaaccagctttggcccacggctatagtttgcctgtttctgctctagagcccaataaacttagtattccattattggctctggtgtttagcagatgtatgatcttgggaaagtctgactgtctctgaactgtagtgtctttactacaataacgccacctacttcataggtggtggttagaattaagtgaggtaatacatgaaaactgtttagcacagattctggctcatgcctatatgaaaagtaaatcagagtcattatttgtattactattaagataaataatttatctttctggaaagtaaatttcacactgaaaatcgtatttgttttgctagagaatttcaaattttagagaatgattactcaaacatctgtcaagaagtaccctattttatttactccgttttgtgagaatgatgagaacgcacagaccagaagaaaaccaagacagagatactgaacctgccgcaggatagcttctttatttgctaactcattttctagtttatcattcatgtcatgtatggaggtagattctctctgagcactgaggtaacgcttttcaagggttgtaattctttcttccatatcttccttttgtgccatggcctacaattaaaataatttagaaaaagcaaatcagattctcagattgtttaattattgtcttgttagttaaataaaaaagaaacataaaaactattgcattcttgaagtaaatactcattcctttcttttcattgaacgaatgtgagattgcaggtgcatgttcccaacttagctatcagaattatttttgtatcttcggttaaccaaaagctttctgctgtctaagaatgcaatggagtagcttttgaaactctctactgtagaattggcattcttgtaagacaagtggcagataaattagttcattatgcagtaaaattaagtacaataatgagtagagttgcaaatcataaaattgttaaaatggtggctacagttctaaattgtaaagcagtcttcaaatagataacaaataccatccgtattcttacctttacattaagaaagaggaactctgtggttaaaaggccaggccaaaaaaaaaaatagtacatttggatcttatttataagtttaccagctgacttagaaacttagccatttacctagttatatatgtttcaattacataagattttaaagaagtccatgaacacataaatataggaaaaaatcaagttcaagtggagaaaatcatggcattgataatattttaaacagtaatttttaaataatagaatttatagatagtaatatggagataattttacctcacagcttacatggaaatttattggtagttagataacctactttattgacaagatgttgggtgaaaatcaagtgcagaagtgaggctcattggcctggaattgtttcctgagaatgtgggaagcttctttgtataaggatcctggaattgaggaaatggctatagtttccatatcttattatccagaatcatttcatcacttattcttaatcagtgcctttgtcactctcctacagggtccagagccagtcctgtcacatataataatcagataaacagacagcctttcttccaattttctttcttttttttttcagatgataactctaatgaaaagataggttgaataaaaagtaaaataagaaataaaataggtaatgtcctaatctaatataatagcaagacataaattttgtttaaataaagagagaaaataccagaagtagtggataaaagggttgaaattaagaatttcagggaaatgggatgaaaacttgaagtgagatgctgtgtgtgtttatacatgtaccatatttatacgtgccattatttgactttgagaatttttgtatatataaaaaattaaaattaattaaaaagtaatagatcagccagaggcgatggctcacacctgtaatcccagcattttgggaggccaaggtgggcagatctcttgaggtcaggagttcgagaccagcctgcctggctaacatggtgaaatcccgtctctactaaaaatacaaaaaacttagctgggcatcatggctcatgcctgtaatcccagctactcagagaggccgaggcctgagaatcgcttgaacctgggaggtggaggttgcagtgagccgagatcgcaccactgcactccagcctgggccacagggcaagactccatttcaagaaaaaaaaaaaaagaaaaaggaatagatccaccatgaaactcatcatgttgtccctagtctcctgcccacccacaagttagctctctctcttgtattttttgtcttttattctccttacttttcctccacgctgctgcctgagagatatttctaaatgatcatattgcttcttggtttcaatacttttatttcttcccctccatcttcagggtaaaatctgagctacaaagcctggaataaaagtggttttgtgacctgatacttccttacttcagtgtactggggctaataacatccccccaaaattcgtgtccactctgaacctgtgaatgtgaccttatgtgcaaataagattttgttgacataatcaagttaagatgaggtcacacaggattaggataggccctaaatccaatgactggtgtttttacaaggaggggatttggggacacagagatataccgggaagaaggaggaagtcagtcagagaattgcgttatacggagttgtactgctaccagccaagaatgccaatgactcccagtaaccattagaagctagaaggggggaagaagaaatctcactagagccttcagagagaatatggccctgctgaaacattgatttcagacttaaagcctccaaaacagtgagtgactaaattatggttgttttaagccacccagttggtggcaatttgttatggcaggtttacaaaactaatgcactctgacatcatgtctacctggaatgtgtgctgtcttctttgtctagctcaatcctactgaccaccaagacccagtcaaaagctacttgattaattatgttgacattaaagtgcaaacataaaaaattaaatttaatctatgaattcagcaaaaaatagccagactaatttttaagaaatattatatacatactcctagattttagatatcctaaataatgcctactatttaaaaagctatttattttcacttttgactttttctactttacatattttttatctcaatgatggtagagtttttatcttagaggatcttttcagagtgcttaatattgtattctgtcagtttcatttgcaaacagaactctgggaaaattttgtggtctgaagagaaaagtctaaagctaacctgtgtaaataaacttcttactaaattttaacagcaataaagtcaataaaagatatacacacatttctcaagaacgtgagcactgaagtagtacatacttgctccaaatgctagtttgggacacttattaactctgttataagggatcagtattggtcaccttttccgtgcttcaccttcttcatatattgtgtgggttgagattctaatatgtagcacatagcattgttgttaagaatcaggaagtgctttgtatggtgtctcatgcagaaaacaccctcgataaataatagctgttatttattattaattactattatgtacacaattagatgatctcactctatgacgtagattacatgcaggaatttttgcattttgtaattttggtactgcattttttgattcagtgattcatgtgggagattcaatttttaactgcaggctgtgttgccaaaaataaactggatttacaagtcagagaaatagcttttccctctgtcatttgaaaaattctgaaagaggaagctttttctagtccctaaaacttgctacctacaaaaaaaatgagaaaaaataaagattcaatgatctcttgacctgaagttcatgtataaattggattttgttcatatttaataaatataactctctggtaatttagatctattaaagtgaaaaatataactacatgtttcagataacagaaaaggcaacactgagatgtatttaattcatttaatcacatagtgaaattctgaagaactgttaataggaagttggaaatacaggatggttttattcacaaaacaaaatgtaattaaaatactccactgaaaattttagctactggcacagctatgtatttgatatatcattatccatacacaattaataatccttttgattaaaaactggagagataatccacttgtatgagattgtctatttttctaatttgagtgctgtgtctagctttaatccaactcacgtattcttcctagatcaaaatcaatttaaggagttttgtttgaagacaaaatgtaaaatgaaattaaattttggataatttcttttttgacaaagaaaaattacaaaagtatattctgaagccatcagtggaacatatttataaattagattggtgcaaaagtaattgcagtttttgctattcaaagtaatagttaattttagataccttagaatgtcctcacatgcaaagcaaattatatttctgttttttattatatggttgttttttcttatttcctaatttttactcaattattacaacatacatttattacctgtacaatttataaatcatactatgctagcaatgctataggagtatcaagaaaaacgagcttatttttttctactaagaaacttgcaatccgtggcttatgcctataattgcagcccactgggaggatgaggtgggaggatcccttgaaccaggaatttgagaccagcctaagcaacatagtgggaccctttctctacaaaaaacacaaaaattttccagacatcgtgacatgtgccctgtagtcttagctactccaaaggctgaggtgagaggattgcttgagcctaggagttcgaggttgcagtgagctgaaaacactactgcacttcagcctggacaacagagcaagactctttctctaaaataaataaataatattttaaaagaataattaagaaaaggaaaagaaacttgcaatccagttgactctatgtgaccataacccggaaaaatattattcaggaaaataaaagctttaagtgctaagtaatttgttttttaagtacgtgattttcacatcttcctgcttattgaaaaaaaaagatccaaatattgattatttagaggacagttatgttgtagcttcattttatgatagttgctatcactgaattatttattgtgctgtgttgattttggaagcagttcatagtggaagaagcacaggttttgaagccatgctgatcttatttctcttccgtgctgccgaggagggaactgcatagatctttggcaagttactttacctcactgaaccttgtgggtctcatctgagaaaaatggagataataattagcattgccccttttgccagttgtgaggaatttgagactttccatgtaatacacccgtaatagttttcacatgtgactcgtccttaaaaaatctttcataaaccatgggcctgggtcttgagacctgaatatttcagaattcgtttatttagctttcacagtgctgtgtgtgtgtgtgtgtgtgtgtgtgtgtgtgtgtgtgtgtatacaaaaaaaaaaaagtgatgcatgcagtaacgcaggctgagtgtaggccatttcacaggtttcatcaacgccatcagttcctacagtcttgcacctggcactttacacttttccattgccagcctggctctgaaaacatttgtgtttgcaacctcccttcaaaggtggatgatgagagatattcctttctcaggaaactcttctaaaatatatacatagaaacgatggggctgataagagtagttgtattttaaaataattccacatgaaaggagaacgttttgcccattagaatggattcttaataaaagaacacctggcatcataggagtgacattttccatctgactgggtgttttgttacctacattcagaggctattagtatcaaggagttatttttaaataggcagttagaaaatggggattgaatgttgggccttacctgtaagtgatgctggattagataagcattaatagagcaatgagtactaagatgaaaggaaatcatctaaatctccagggccaagagaatgaagatggagagaatgaacaacagaccaagaagtgagcccggtgatttgatagccagaaatcctagtaattccttaacagtgatacagaagaggggttaaactgcctttactttatgaattctctgagtttgaattgtggggagtagtgaagagaagagatgcatccatgaactattatattaattcataaaaagttgtatcattatctgtgctgcagtggagcagtctaccacttcatggttcatctatctcttttttttgttttgttttgttttgttttgctttcaggcattgtcgtagtacatattctgatatcattcacaccttctgatatttacttataaatatctattctttcagcaaagattttttgagtgcctattatacaatcaatagctgcgcaggttctctgaagacagcagtgaacaaaacaagaaaaaaaccctagctcttatagatgtttacgaatagttggggtgggaggcatatgataaccaagtatatcagtaaaatatacattgtgtcaggtgatagaaagtcctgtgggataagcaaacaaaagaagagggagagtgtatatgtgtaaataacaaggtcaggggacatttcactgagaaaacaacattgaacaaaaggcagagagaaaagaaaatgtaacaaaacaggtctggcttgcttaagaggtcactccagttgagcagagcatgttaggatgagacagtagatgatctccaagaggtcaggaaggtggtagtagagagattgtacatggcttgtagaccactgtgagggttttgataatagtgtaagtagaataggtagtcactgaaaagttttaagcagaaaagtgacatgaactgacttataggcaggctgctcaagctgctgtgttgagcacagactgaggtgagctgaacgcatgagcaggaagaccaggaaacagatgaccattgaaataatccagtgagagaaagtgattgtgtagaaaaagcaaaagccatgaagattctgagaagaggtcccattatgaatactttgaaattgtaaataacaggatttactgctgaatcaaagcaagtgtgtgaggggagagatcttaaggacagcttcaagattgttggcctgagcaacaataataatggataaggaagactgcaggagggtctggtttgctgagaaaatatcaagaaaagagtctgaagtgctaattttgagatatcccttagtgactgagagagaaacatctggaaatcaggaaagaaggacaagttggagatattaattgggaatcctaagatgatggtggcttttggagccatgagactgcagaaattcaccagggaaataaaggtaggtagagaagggaagacactccaaggtcggggaggagaaatagaagcagtaaaggagccttcgaagaggtaagcaagtaaatacggatgaaaaccagaagaggataatgtgctatgagcccagtgaagaagtcctctggaaaatggatcaagtgcttcagaagactgagaattgaaccttggattcagtaacatggaggtcagtaatgacttttatgagaagagttttggtggaacagtcagggaaaaagtaagatacaattggcttacgagagaatgggaagaaaagaattggacacatagaatagggccaacttgatgaacaactagctagttatatacaaaagatacttttaaaagataaaaatacatttaaaagaatatgtaaaaatggaaaaggcaaaaagtcagaaaacgcaatttccacaaatataattttcttttcagttgtgactgaaaaggtgaaaaagtgaaaagattctaaactttcaccttagcaggtaaaatgatttgacagtgttacaaattaaacatctcctagtatttttttttagtaacttaaagtactctcttcacttgatattagccaagagactgagaaatgactaaagtactcatttttttaagtagaaaaagggatgttatgtctaacaggaatttaatatatagacaaagaaaggtcatgttatacatatgcgtgtatatgtatattaacagagatacattccccttcatgacacaaaaccaaaataagcaatggaacaatttaaggcatttttgtagtattcctatatgctaagagtatagcaattcatgattcatacacatatctagagttatttaaaattaaaagcttacatttaaaaaattttattaacagcttcagaatgtctttgttatatctgacccttgatagcacaaatttctttccatatatcatgggcatttaaaatgctcatgaagtaaactatgtttgcgctattgaacaagtttcataactaatataatgcatgccaaagtatggtcttttgagaagtaaaaagtgtatggtcattacgggaaattatggaaacagtatctcagaagcagcattcagaaatcaaagactgaaagtggcatgaatcacttacctccctaatgtccctttgatacttggtgttcatttcttctgttttaatgagatcctttcttgctgtctctgcttcctgttccacctctcccactcgggaagaaagggctgctaaacgttctttcatctgggccatttcatagttttgcttttcaagcaattcttgtagttcaactatttgactagtttcatcggttgagtctatagaaccattggacaaacgctgcagaaatagaaaaagaaatggcacttaagaattttcatctttaatttaaaatttaaaataaacttaaagaaattaaactgacactgctttcacagtgagaaataagaaattctgaaaagaactagttttgccgaaaaactaagtttctaaggaaactgttaattgacattaaaatatgaaggtagatcagtaattttcaaacagtttaatagatgtatttgaaatatgctatgctatgctctctctatatataaaacatagcataaaacattgatgtatcctaaacatttaagtgttagctactattttataaattagatatataatttattattaatttacaatgctatgatataacaccatacattatttttaattaatgggtaaggacctataaggtgtacaattttaaaatttttcttcaagatcccttgtaaatttttaagttttattttcaatgatgcccagaagaataacttaccaaatattttttatcaaagattattcctgctgtgaatctgacctagctggaacaaacatatagtatagaaaagtttttatttctatattgctattaacataaaatcatgtgtgcacacaactcacaggaaggaggttgaaaggggttaaatattttgagagctgatttttcttctttccgaaaggactgcttagaaaccagggttttctaaaaatatgtcttcagaagtatgccctacagctaaagtccgaaatatataaacaactcaaacaactcaatagaaagaaaataaatccccagataagaaacagggaagagacctgaataaacatttctcaaaagaagacatacagatgaccagcagatacatgaaaaaatgctcaataccaacaacgcatcaggaaaatgcaaattaaaaccacgatgagatatcacttcatacctgttagaatggctattagcaaaaagccaataagtgttggtaaaagaataagaatgtggtaaaatggaacccttgtatgctactagtaaaaatgtaaattagtatagccactacagaaaaaggtatgagagttcctcaaaaaatcaaaattatcatatgatccagaaatctcacttctgggtatataaccaaaggaattgaaatcactgtgtggaagagatatctgcactcctatgttcaatgcaaaattatttacaatagccaagaaacggaatcaacctaactaagtgtctatcaacggatgaatggataaaagcgagtgtggcatacatacacaatgaaatcctattcagtttctaagaagaaggaaattctgtcatttgtgacaacatggatgagcctggaggacattattctaagtgaaataagccaggcacagaaagacaaatacttcttcacctcgcttatctgtagaatctaaaaagtcaaactcatagaagttgatagaagaatggtggttgccagaggctggaaaaaaaggatagctgtgatgagttaatgggagatgttagtcaaagagtaaaataattcaattatacagtaagaataatggtctattacacagcatgatagctacagttaataataaataatacattgctagaagagtagattttaagtgctctcaccacaaaaatgataagtgagtgagtgatggatatattaacttgattgaatcattccacattgtatacatatagcaaaacattacattgtaactcacgaatatgtacatttattatttgtcaattaaaaagtaaaaggcctggtgttgtggctcactcttttaatcccagtgctttgggaggctgaggcaggagactgcttgaggcgatgaatttgagaccagcctgggtgacatagcaaggcctcatttctagaaaaaaattaaaaaaaaaaaatagggtgtggtggcatgcacctgtagtgctagctgctcaagaggctgaggcaaaaggatggcttgagcctaggagtttgaggctgtagtgagccatgatcatgccacagcaatccagcatgggcaacagagccttacaacctttaaataaataaataaataaataaataaataaataaataaataaataagaaaagaaaagaaagtatgggctgtatgtggtggctggctcttgtaatcccagtattttgggaagctggggtgggaggatcacttgaggccaggagtttgagacctgcctgggcaacatggggagactccaactctaaaaaataggaaaattagccaggtgttgtggcacgcacccatagtcccagcaactagagaggcagaggtgggcgggttgcttaagcccagaaggtccaggttgtagtgagccatgattgcattagcgcactccagcctgggtgaaagagtgaggctctgaccaatagtaataatgataataataataataatgataaataaaagtatgctcctcagcctagctactttggagaagttttgtagtgaggacggtgcagcaatttgggagaaataactaagagaaaaagaacataagtagaaacaaaaagtatggagagaaaatacagaaagtacagtcatttccgctcatgttttcagcacttgtttaaaaacatgaatttgtttcaacatgatagatatattataaaacaatttcaatgtaatgcaaatttttttaatatgcaattttgttcctgagaagcactggctaaatacagaaaaccacacctggctgaaacaagccacataggaacacataaaatgcacacatgcccattcctcaaatatctaaaactgacctcaatgccccttgtatgtcataaatttgcccatcgacacctgtgttacaactttctgatttcagatacctttccttctaccacttcacaagaaatgaaagcctttaagtcttctaacacttctacaagcaaacttcagctctttctcggggaaaaaaaaatacttatcactgtatttgtgctatctccaactatttaacaggtgtaaaattgtgctaccatttttattagcttttttacttttattttaatgtgacactgataaagtttttagtgttgtgccataaacttcattacccccttaagccctgtgatttttattgcacaatattgcatagttcatgatatttaggaatgcaaatgacacatagagtagaatggactatagaagaatgagaagaacagaaagcatcatgaaagcagtgagaaagataaaacacagagaaaggaaatgcaggcaaatggcaagaagtactgtaagtccaataacctaaacaatgtgagagtgtggagaaatagctgagagaatcaaaattaaaagagcagagaaagatagagacaattgcctttttaaagttgactagaggaatttctcaatgtgagaaggtagaagttctaataaatcttatggtggtctagttacttgtagactttatacaggatttgaagatatttaaaattatggcaaaacccctctaaaatcagttatcatacctcagttatctcaaatttggaaataactgactggcaattggttccacccatcttccctaatccagatcttgggtgctgcctaatgattataaactggcctttctgagttcagtgtacagatagttgtgtactgtagaagttcacaattccctccctctaagagcaattcccagagaaatgttcagctctgatccttcaaccagcaacatttccagcagaaaggggaatacagactctaaagggaaatgtgattaatgaactgcagtatgcactccaacattcccacatattcgtagcagcacttaccccttttattaaatagaatttggcacccaaaatacaggagttctatgttcagatatggaatgatatcttcaaagaattaggtctgtagattcaacttgtatcttaagagacaatttagtaaccaacagggattccttggaaataacgtttacatactataaataaaagtacaatgcaatcatgctaaataattaaattcaaacacacttcttaaaaatagaagaaactattgtactcttggggtaaacaaatataacttgatatgcttgtacaatgaaaacaaacatattactgatctctccaatacaatgaatgaatcacaaaaacattaagctgagaaatagaaagtagatacaaaagagtacataatgtgtgattcaatttatttgaaattctagaaaagatcatcctaatctatcatggcaggaaaacagattggttgttgcctgggctgggagttggaatgggggaggtggggttgacttcaagggggcatgagagcacttctaaggtttatggggatgttctttatcttgatttgggtgtttacggaggcacatatatttatcaaaattgacagaattgtgcacttaaattgtatgttacttgtacattaatacatttgcttaaaagcctataaaaaccttgaaaaacaaatttttattttgaaaaatgtttcatagaattgaaaaatcatatttaagattctagagctctgaagaattttggagaaactgagactcaggtaatcacatagaggtgatctgaattaaaatgcagaacttttattcccagttcagttaatttacgctttaccacattgcctctaatcagaacatataaatcaacaggataaaattatatatgacgcatggtataggcatgtaccaagcaggtaccaagcatccacacaccattatatatatatatatcactcacacaccccaagccccagacaaccactaactactttctgtcacacagattcgctgttctggacttttcacagaagtggagccgctgaacatgtgttctttcgtgactagttttatgcactgagcatgatgtttttgaattttattcaatattttatatatatatatatatatacacacacacatatatgtattcagtggagtttatatatatacacatatattatatatatataatattgataaatatttatttggtgcaaatgaacgatatttattttctaatttgaaaaatgtttgttccaattctgtgcacctgcgctccattaaaatcttgttaatgcacttaacaagaaaattgcatacttttaaatgggctcaaggtaagagaaatttaactaactatagatagtaatcaggcaattaaaataaaacgcttttaaaatgttaactttttaaattccattaagcagtaaatgttcactgcatagtctttatgctactgtgttgggattacccatgaggagattttaaaactctcaatttttattccatagtgtttatgaaacttgcatttgcagaaaatatataatcttttatttgttctcattaccttaaatagattgtatcgtgagcttactgtgtgtcttaataatatcagaataaaaagtcatattaaaactgtgatttatatcttagaaaaagatcttgtttttgttccaaaccattgttaacttgacttacctttaaaataaattgtggcactttaatttaaatgacaaatggctgtattaaaagtcagtacttattttaagcagctctactgggatataatttacacgccataaaacgcaccctttaaacataaaaagttcagtggagtttagtatacttacagagttgcgcaactatcaacattagttaatctcacattttttcacccttagtggaaatcttataattattagcaatcactgacacacccccagccccagacaaccactaactactttctgtcatacagattcgcagttctggacttttcacagaagtggagttgctgaacatgtgttctttcgtgactagttttatgcactgagcatgatgtttttgaatttcgttcaagtaccgtagcatgttatccacacctcatttctacattgatgaatagtattccatcatggggatatattacatgttatttatatattcatcagttgagggacattaacgttgtgtccaccttttggctactataaataactgccgtgaacttttgtgtataagtctttatacggacaaatgttttcagttctcttggatcgattcctagagtagaattgatggaccatatgacaattctatctttaacatgttgaggaaatgttttccaaagtggttgcaccattgtacattcctaccagcaatgtatgagagttctaattttccacatcttcaccaaaacttattattgtctatctttttatttcagctattctagtgggtgcaaagtgatatttccttatggtttggatttgcatttcctaataactgatgaagttggacatcttttcatgtacttattgttcatttgtatatcttatttggagaaatgtctatttaaattatttgccttcatattaattgatttacatgtatttttattgttgatttacatgaattttttacatatattttgattcaagtattttatgaaacatatggcttgaaaatagcttttctctattctgtagaccatcttttcactttctttcatgatagtattctttgaatttcaaatgtttttaattttaagaagttccagtttatcatttttttttctttgtggcttgggctcacggtgtcatttctaaaaaatcaatccccaacagaaggtcataaagattttcaattttttaaagcagtacaagtatatatttgaaattattaatgatcaaatacaatggtgtctcatatgttaaattttaaaatatatatttatatttactcattcatcaatatttattaatcacctactttggtgtcaagtggaagataataagttttagaatgttttaaaaggtgataatacttttctgacatcaaggcaattctatcaagcaaagaagtaatacacaaataggcaaggatatgcattgcaataaagtattatcataaagttttattttgcttcatatttatgtgtgggagcagaaagcagagaatatctttgtgatatcctttgagttgggtcttcaaagatgagttattatatttcaagtaaaggaaaggaggggagtacttattctaggagcagaaaataacatgagcaaagggagggggatatccctgaagaataattgtaagtcgtcctgtatgcagagcagaaaacatgtgctataaggaaatggtaaaatatgagacttgacagggaaggccagcatagattacgatggcctttgtttttccatactgaatagaataaactttgggtaccagatagaatgacaaggagccatcaaagttgtttgaacagggaagtaacatgtaaaactgtgcaagtaaactgttactctgtcatcacaaacccggtaattcagataaagccattcctatctgtaatggataatttttgcttgtttgttcaatatcctcacagctagggttgccagatgaaatataggatgtacagttagatttgaattttcaataaacaatgaaaaacttgagtgtaatgatgtcacatgcagtatttgggtcaagcttatactaggggaattgataatgaaaagaaagcattgagctaaaccctgcaatacaagcataaatcatgcagttttctggcagaggaaacagaaagatcaaagacaaagtgacacaagtgggtttaggattttcaaggagaccattgtagctagaatggactggactaaataaagcaagagggtgggagtggatatagatggaaatatgatgtgtgttcttgagatcattttaagactggcttttgctcaaggtgatatgaaaactataggaaggtgttgagcagaggagtgacatgatttcacttacattttcgatggattcctcagtcctcttataaaagacaggacaaaaaaaggaatttaagaaaatgaattaagaggtgaaaaattacgttggcttagaccagggtaataggactaaaggttataaaaggggtcatattctttgaatggattgaatatgatatgggacaaaaagcatagactcaaggatgactgcaagatttgtagtcttcgattagaaagatggagttgctattttttgagaagagaaaatctgtaggagaagcagatttgtggttaggatggggcaaaatcctggactgggttttgaaaacaatgtttgaaatgactaattagatgtcaaaataaaggtgtcaggcaagctattgtataagcccacagtaaagaatagtgaatatatggatgttttctgcaagcagctataacattggatgagatcacctgtggagtgaagtagggggtcgtcaaagatgactaataacgtctttgtagaactctcttcaattgttactttatcagaaaggcctttcacccctgccatattatatatttacaaaatatgtttgttgtctttctcacctaccaaaatatatattcctaaaatttttatctctattaaaagtttaaatcttaacttatatattattgtacattcaactgcaatacaattttcacacttggctgtcaaacagactttccaaactcaatatgtttaaaatctgtgttcagaacgtgcttctcccccaaatatgttttgctttaattcatccccaactcaattagtgagaacttcactttttcactttctccaaaaacggtggagtcatccttgagttctctctttttctcccatcttttatacaatctatgagaaaaacttgttggctttcttttcacaaaatatgtgaatgtgacccactgtcatgacctccaccattgtcacccttgtctgggtcatctactctcctttgaattactgtaacaatcttgtaactggttctttttttctaaccttgtttcttattttcattcttatagcagtcagactgattcatggtgatcctgttacattgcagttaagtgaatattcccatgataaatgttaataattatcagaaatataaaaaatagctaggtcccacattacagcatgaaataaacatgttaatgattgatagagaaaaacattcatctgtgaaattcttactctgtatagtttgaagagatgagaagtgtgtatattgagtttattttgtgtatattgagtttatttttttctttagagaaagtcatcaaattgaaagctttcaaatgttttgttgctattgttgttcatctataaaataaagaatcaacactagagtggatctttcttcctggatgaattaccaagtagtccttttagatgtgtaaatataagtcaagtaggctcccacatcccaaggaagaatatttaatagaaccctgacaaaaagtgtctcctctactgtgtcttgatattaagagagtggaggaggaagatatttgacataaaccaggaaacttcaggaaggagaggaaaaaacagattgctcccctttcaattgtgaagttcaatgtttttcttaattctctggtagactgacaattgactagatcacaaggagtaccaagagtccacaaagagaacttaccatgagggaagtaagagtatgaatttgaactatggtccaacacccagtggtggttctggcatggaatctgaaagaccttcctggctcagtcatcttgatgaatttgggaacatgagtatgaacctaaacttcaactggtaaaacttggagaatggaaaattcttcctgaagaatcactttggtagaggttgtcactactgctggtggaactagtttggaaaaactaggccatttattggcataagatggtttaatttggcctgtatgacagtgggttattgcagtggtgcatggatggtgttggattttgagggaacacttgtttcaaaagtgatactttgagggctaaaaatatgcaatagcagttttttaaaaatttactcacttgttactttatcacattttccagttatcttttcatgaattgtaaacaaacaaaaaacaaaaacaaacaatcaaacaaaaaaattcctttttggtctgatcaagttttgaaagtttttagataacttaggcagaacaacattggccccaagaggctggtaccagacttactgttacttggattacttgggctcttatatattttagatagtcaaaaaagagctcaacttgcctgtatccaggtcacaaaaattatgtatgtaaaggattaatggtaggcatagaaataatgaacactaatcaagtacaacagagtttaatttattttctatttttaaaaatttcacttctgtcagagaatcatgcatacaaaaaaaaaatcaagttgtttatccctaggaaaagaaaaacagttccaaaagaatatgtgccatcattctcagcaaactaacacaggaacaaaaaaccaaacaccgcatgttctcagttataagtggaagttgaacaacgagaacacatggacacagggaggggaacatcacacactggggcctgtcagggtgttgggggcaaggggagggagagcattaggacaaatacctaatgcatgtggggcttaaaacctagagacaggttgataggtgcagcaaaccaccatggcacatgtatatctatgtaacaaacctgcatattctgcatgtgtcccagaagttaaaaaaaaaaaaaaactgtccatgaaatccactacttttgaaagatgagtatattgtattctgaaaatacttcttagcaaacttgtaaatgaaattccaaacctgataaaagctatctaccagttactatgataagcatcacattaatgaatagcattattattaaagtctatacttttacaagctttatatgtcttggacaataacaataaatgaaaactgaaaaggaagagaagagaaaagtaaatcctcccaatctgtgtaattacttagaaaataccaagagtatagcaaactcttagaactaatagttttgcaagtttgctgtaatccatatcaatattggaaaatcaatagcatctttatatgccagtattaatttattaggaaaaacatataaaggagataacaatcacagtaactataaatgcctagaaataaatctaatcatatataagatctctatgggaaaaattaaacaattttattgaagaacataaaataatacacaaatgaatggagacataagccatatgtacacatggtaaaacagtatacaatagaggcaataacttcccgaagttaatttattaatttaagcaattgcagtaaaaatcttgttggggcacagaaaacgattcccccaaatatgactttggcttgttgagcgctttgaaaattgaaaggcctcagaaataatccttagaaccaagatctgtctctgaccttcctctcctccctttctctctctctctctctggaatttccttatctgactgaaaacacttctttccacaaggaatgtaattgtctcaagattcccctcttcaggaatcctgtcagattaaccactagagaagagcagaaattgggagtcgtcatgccaagacagatttataatctgttcttcagaggacagctcccagagattacccaggggacttaatctgcaataataaagcaatatttattcctgcacagtctttccccttactttcctttaatttgtcagtcccacccagcttccaaaaagaatcatttgcaaaatgtctgcctcctgaatccatacatatctcctatgtcgagaatatttaagcatcagccctctggcccctcttccagtctaatacattgtaaatggcagttatatccatatgcgtgttaaaataagttttgtgtgccttttttcacattaatctgccttccctcaattcattttcagcaaacctttagagggtggaagaaaattttctccttggcccctacaatctcaacagagttgaaaaatggaatttgaaaagttgatattataattaagctctaagaatcaagatttataaagttaatcattaaaacagtgtgatatttatttcttattcttgaacacgtatttattaagtgttcatcatgttctaggaactattctaggtacctgagcttcatcaggaataaaacaaggatcctaacttttatggaggttattatctaactgggctggcagacaatacattacagacattataaataagtaaagcatataaacacatgctgtgctataatacattactatgttagaatatgttatgacatttgaacaaagactggatggaagtggggaagttagccatgtatctggaggaaaggcaattcagacaaaggaaagaggaaatcaaaagtcaacaggaggccagtgtggctggggtggatttggatgtgaagtcagaagataaagacagtgagatttatgtagagccttgtgtaagtggaaagaagttgcagagttttgagcagacgattgatgtgttcagatatatggtttaaaacatcactcttgtatcaaaatatcacatgcaccatataaatatgcataattagaatatatccatagacatttttttaaaaatgaaaatgaacagattactctgattcatgctgttttaaaaatagactggagatggcccatgggagaagcagagagacctcataaaaagtgattgattacaataattcagctgagagatgacagtggttcaaaacagagtgatcaatggaagtggtaggattctggatatattttgaaggtagagtaaatcaaatttctttatagttggatgggaggtgtgagacatagggaggatgtgagagtaattccaaattctttagcttgagcaactggaaaggcaaagttttcatcatgtaaactggagatgatggatcaaattttttaaggggggatatcaaatacgtaagcttttgatattttaaatgtgcaaagtcttttagatatacaagtggagatgttcgattgtggctggatatatgcatttggttgtagggtctgaactagaggtaaagattcataaattattagtatatgaataggatgagattgattggaatcatggagagagtgtaggtagagaacatgtggagggctgagccctggggtgaagaaagaaagagaagaagagaagaaactgggagttgtcatgccaagacagacttatcatctgttcttcagagagcagatgctccaacattcagaagtcagagggaggaaaatagatggagatgtagccactggtaagtaagaggaaaacaatgtagtttcctgtaatgcaagtgaagaagtatatgaaggaagaaaactattaactatgtcatatactgctgagacatcaactatagcaaggcctgagaattggccttatatttagcactataaatttagtgatgactgtagcaggagtggcttctgtgctatggtggggcaaaaccttattgaaataggtttataagggattttaaaatgtggggccaaaagataattttttttaagttagggaaactttgtatattataagaatacagtcgaccaggggtgcccacgttccaagccatggacatgtactggtctgtggcctgtttgggaccagacttctcagtaggaggtaaaggtgtgagcaaagcttgatctgtatttacaaccactccctatcacttgcattaccgtctgagctctactttctgtaagatcagcggcagcattagattcacaaagtagtgtgaaccctattgtgaactgtccattcgagggatctaggttgtgcactccttatgagaatctaatgcctgactatctgtcactgtcagacaggaccatctagttgcaggaaaacaagctcagagctcccactgattctacattatggtgagttgtataattatttcattatatatttcaatgtaataatttaaataaagtgcaaaataaatgtaatgtgcttgaatcatcctgaaaccatccccaaccacacccccagttggtggaaaaattgtcttccacaaaactggttcctgttgccaaaaactttggggaccattggagtagacaaagaaaagaaaatgatggcaaaggaaagagcagtaaaatttgctggggaaatatacttgattaaatgtttgctgaagacattacacatggtgtaacaaagttttctttgactaggcttttttgaaatttttgtaagcctcatgctcagtctaataaactcttccatcctcttagaaacatggacaggtttaagactttgcttaaagtaaataatcttatattttgaaatctataaaatcaggtagtttttatgctgccttttccctccatagttcacatttattctttacttacttgttacctgtttatctccaatccccctgttcatgagctacattactttgagccattgatccttgctctgcaaacctcacagggttgttgttacagagatcaaataaaacaactcacataaaggactttatgctggttacttatctcattcttaaagacccgtagccgctttgttaatgaggtttccagacaagtttgaaaaacaatttggctaactttaaaggttaagcaccagcattccttaattccatattaaggcatgtcctgttgaattctcattctgggatactcttatttccctgtgggtaaagagcgtctctggaaacactacatactgtgtttctttcttgacgctcgacaatactaagagttaaaatataaatactgtagtacttacaccagttaaaaattgtacacaacaatatttcctaatctgcttctcctgggaatttcatttgttgggtgagtgggtcctatcaaacacccactaaatttctggggagcttgtgtttcatgagaaatgatgaaatagataaattctaccaaagtgaaaaaatacaattagatcaactgaggaacttctgaatgaaaaacttaaaaattctcctagccttgcttaacagatcgcacaaaacaaaacagaggaaaaagaacttattcttgtgtacatcaccaaaagacaacagattccttggcacaaaatgaaccctccaattatgttaataagataaaggtaactgaacaaatttccagtcagtcagtcttttaaagtctttggaaatatccttcttcacaaaaaaaaaaaaaaaaaaaaaaaaaaaattctgagtacctcaaatcctggctaatacaaatgatacttcttactgaagacagcagagtggatttcacttcatctttccatctaacaaggtcttagttaacacacaataacccagtcactgcacccagagcgatttgttttgaacctaatgagtttccacacagcattagaagacttttatttttgccattgcatatagaagattccagacctttcgttatgtgcttcctcgccaactcagcttctagaaaattgatacaacttcatgtatatatggataagccatggaagatcctaaccttactcttttggtcccttttctagccaatcattgaacctctgggccagtccagcccatgtatatctttagacctgctctttccaagttggcaaattcataaactccattcagtttggtgtttcactgcttgacaattcaattgaagaataaaggagaaacattcaagtcgttatgttttgtaaggaattagaatacaatatatggaatcaatacacagaagaaaatattctgtgagtgcaatccatttgtaaataagcccaattatatttttgagagagggaatcaataatgcataaaatgagctacagttgacaagactgaatctttgaaagaatggttgttggccgtagttaacatgtattgatgaacacaaaaaaatgaacaaaatatagtcaatatattgaagacatgcctgtggatgatgacttttagtcagaacttagtgagaatgattaaaagaatggcatttgtgataaatgatgtttattagtattttaaaataggatgagatattgataagccaaacttttaactggacagctgacaggtttgcatgagagtgtgcaaatcttcacactatgatatctcaatatttcacaatagcatgatggaatgaaatactttgtctccactgaggatcacattgcttgtagagctatgttggcttgttctaagtacctatttttgtcattggttgttcattctaaaacagcattgtattgctaaaagtccacaaaacccttaattttgataaaggcacatcccgtattccatttttatcactttggctcaatattcttcatgaacagtagttctataataaaaatactagacaattatttattaaatttaccgatctgaggattattcttgccactgattcttcattttgctttatgtacttttttgtccataattcttctatctgacaagaactaaagaactgaaaacatgcaaacaaaaatctatttctgattttacatttattcagctttcacatttccatattactgttgcttaaattgttatgttgcatttttagagaacagtcacgaataaatgtcagattcaaagaggagagaagaataagagcaacaacttaaaaaaggaagctttaacttagttcacttagtaattaagctcaaagtgggaatgataagcaaacaggcctgggaggcgagaagaggccagccagcttgggaagaacctcatgtgacatgccgaggatgtgcctcatttgttgtatggtcattgaaggatcagtcaactccactcttcgatctatgaagaactagtgtctcagtcactaatacatgacacgtataaaaattcactgcatatagttaagtgtgactactgttttgtgaaagtttttcatattgttgactcctggtactttttcaggcatcagttcaaatcccaccatcttaaaaagatcccttctttaatgtcttcaccactcaccttgtacgggtcccttgatcatatctatgcccttttacactgtgtatatttgtttattgcctgtaccctcaactgtcttatcatcattatattcctaccacctagaatagggcccatttcttagcacctttaataaggttgccactaaatatttatttgattgaaaacacaggattaataaatagaataagcatttattgcttctatacaatatgcctaagatgatgtaattcattgaatatagtgtttctattcttataactctgtaagttggcaagactattttatctgaaactcagagtcagcggtgttaagggtaaggttcatacagctggtagctggcagagacaggaacttcaaacaaatcgctattccacattgcctctctgacacccctcaatgaggattaattaaccttgtttttaaactctaatattatttttgataccacaatatttatcatgttttatgatattaatttgggcatgtttatttctcactgtagattcttatcaaatttattacagactatatcttctgaatctctaacatatctaatattctactgattcacatcagttagcaaatacttgcagctgaaaaaataattagaagtacagattatacaagtaatgagcattattataaactttacaagagtagcatgtttactttttaaaattcaccaattaacttccatctagaaagaaataggaaaaagttattagagcctggttctgaaaaggtggaatttagtgttatgaaaatttgtattatccttgaatatttatattcttctcaatcagttaaatttaagaccacacagaaatatttaaattcgtttcagttaagtgtattttttctttttattttttcttttaaaaaggctgataataattaccagagttttccatgaataataaggcctatttcagattgtgcttttgtgaggctatttttgtcaactattttgtcaacagagttctcaatccaccgacacaaaacatcttctttgggctaatcacccaccctgactgtgtaacttaagcaaattaactgccctaaacaaagggtaatccttccaactaggatttagaagtcactttcttagttctatcagtatctaataatagttttacatttttgtcctgatcaaccacttttcaatttacacactaacactacagtcatcgttgataatctgccaaaataataatttcttttcttttgtttgaatatacctttttaaaagttctcaataaaaaaaaaataagtattaggctttaaattacaatcctttgacaacttgttttatggcattaatataccttgaataatcatgtcatggaggatgattttgataagaaaaatgctctataatattatatgtgtgtaacttgggagtatttatataaggacaatgaaaataataatcaggatactgttttatgttttatcaagaaatgtcaggtaaaaaaatgtggtatagctgagcacggtggctcacacctgtaattccagcactttgggaggccgaggtgggcagattgcttgagctcaggagttcaagaccagcctggtcaacatgatgaaactctgtctctacaaaaattaccaaaattagccaggcagggtggctcacgccagtaatgttagctacttggaacattgagatgggaggattgcttgagcccaggagaaggaggttgcagtgagccaagttcatgccactgcactacagcctggactgtctcaaaaatatgtaaataaaaataaatttaaaaatgtggcataaataaaacttcttattacaacactttattggaacatcctgagaaatcaatcacaggattaatataaattgaaacatgtttacatatttttaaatttagactaaatatatatgatacattatacacattttaggtttacaccaaaggatatgggcatgatattatgcatgataataatatataattattctaaagcatttagaaatcactgttttagaaattcaaggaagctgaaaaaagcaaatgaataccagtaatcataatgtttaaaaacctttagttacaccaacacaagaagtgaatgacttagcattggcacacaatttcttttctccactggctgaaatgccttcactaagaactggaagtcaaaaaaagttaaagacaattgctttgggtcaccaatgtctcaaaatcctccatatgtgcacttatatctgtgaagaccaatagagacaaatatcaattatgcataaatcctcatcctaattctgtaaccagttcccgaaaaataatctgtcataaactgtcttacattctctaatgtctgcatattcaaatatttagtggttatattgttagagtaggtagttaggcaaccaataggtgatggtcaggtggttgttaaactctctctgtaaaacaattattggttgctgccagtgccagggaagacagactgtaataaatagaaaacattgaatctggtgatcagcagtttccagataagatctcaggagttgggcaagtggactcaagcatgtgcactgagaagcaaaatggcagcatttaactggtataggaatagaacattcctctaggaacactcaactggtaagggaaaaatgcctccagtaagcatgtataggacttcagtaaacatgctgtgcatgcggcccctcccaagtgctgacaggccaccgtgcatgcagacagcccaccccaaaggaagaatcagggcagaagtaccacaactccagaagcatgccagtgtataaaaccccaattcagaggtcaaattgcacacttgaatctctcaagttgcccatttggcccttttccagctgtactttatctcctcttgttcctgctctaaaactttcctgccctgaaacttgccttggtctctccctttgcctcatgccccacagtcaatttctttcttctgagaaaacaagaattgaggttgctgcagacctgtatggatttgctgctgctaacagtaccttgatgaaaaaatatttgaaaaaaatatatatgtatgagcattccctgccctcctcctccataagaagaacacttcaagtatgaaataacctgttaggggataaaaaaaatctgaagttgttcatgtctgagaaaggtatatttcttcatttctggagtagattagcataaatacagcattattatagaaaacaataatttgtagccttttatgaaaaagactagatgaccataaaatccattttttataaccagccaattgtgattctataattctctgaggagaggtatactactaatgacataattaaaatgaaagagcaatatcaaattacatgttggtttcctaaactgagtgctgagtgaaaatgccttattaaagagcttggtggtgtatctactgaagcagtatcagtttatttagttgaaggaaagataaataatgttattctaatctcagataaagctaatgaaatacgtcaaattgtagtttatgttttatatttagcttaagatttctataaaatacatggataaaggctaaattcgtggtcttatgtgaagatctgttcatttgtcagccaccagaattgaagcttctttccggaaattcatctgatttacttactttattttgcttttctacttgaaggaagaaacataagaagtccctctattttttctaaccacataagtgaggaaatgctaaacttaatttatagtaagaattctagtgctatttattgtattgtccagtcacttgcttcttaatcgctaggttttagaaactcttgacattttcaattacagcaatttagctagctgattcatgtggtcttcatttaggagcttaagaatccaaagatataacttgttacaggcaaatgattctcctgagtttccaacacaggatgtgtgaatgcctccatgtaattttcatctgattctagacctaccaataacttaccttcttcctcttctgttggaaagaggtggtccagcacagacaccttttgtcttttgctagtggagcaacagagcgctagtttcctttgtgtgggactaaacttcacccaaaaggagaatcattccattataaaaaatgtaaaagtcccatgacttcacatttcattttatgttatctctcattaacaagagtactgctgaggcctcaaacaatgcaagaaaaatactaatcaaataaaagattaccaacaattttcgcagtcataaacaacaaataagttaccaattgtatattatatcacttacaattcaaaagtgttgttttgcacttaaaatagtcctgcctatatatgtacatatatatacatatgccatatatacacacaatgtgtatatatgtactttaaattatattctttatacatattataaattcaattctatataatttaaatacttttaagaaaatcaattaagagcaggtaaaaaatttgaatatgtgtatatgcatacacacaacatatacacatatgtattatatttaagagaatcaaaataagaacaaatattagaaaggaaataaccataaaccttgaacctttgaccaaagaatcaacaaatactaaaaaaatgttcattatgtggtttttatatttcctgtcaaatgatataagaagtaaacatttccatgtaagagcatgtggggtgtgtcataccttctcatggactttctgtccaggttccatcccttcaagatgttctgactctgtggatccctcgcttgatgccatttttctttgtatatgaacattttgttcacgcaaggcaacaatctgcaaaataaaagcactatgcctttaaagtctaaatagggaataaaatataaaaagaaaatgaatttacttcaatgtggttaagaactaatgaacactaacaaataaccagaaagtgaacattacattttactgaattattattcaaaatatgtgtttcaatgtaggtcaccattttgaacaatatttacaaaaattcataatatctctactaagaagaggttaaagcactgtaaaatttacctaagaaaatattttcttgttggaaatgtatctaaaatcaatgatatatttgtattcacgtgatgttaattcagaaattattttttaaattaatttgtaggatgtaataaaaatgtttttttggtctgtatttttaaagtatacaagaaacataaaagattgaaggttaaagactaattatgagcacagcaatttcgcctacactgatagcccatctgcaatttaatataagcagacacacagctgaacttaaaaaaaaatttgtaatgctgtcatgagcatgtattaaatttgttttattattataattttaatgtccattattttaccaaatttagttaatttgcaaacacaaattaagaaagcagttattcttgcaaactttcagctcaattttaatgacataattatttcaattaaaaaacaaattctcgggtacttatagcataagtgatcctagtaatagagtgaaaaatagtatttcagtctttttaaaatgatgttttaaaatacatttgctaaatatatatatatatatcactttgaaaatattttacattatattaatgctgtaacttatttattccatggcatattttattgtattatcaactcagatagtagtcaatattagttctgggagaaataaaggtacatagtatttagtgcacaataagatctgaataatattaaacttacatgtggaaattacaagaccaacatgtcacaagacgaataatcattaactgaaaaaaacatgatatcaaggggttgggtgtttgccctgctacttgacactatttcaatgccatattaccaccatgtgtccatgacatcagttgatctagctatatgatctctggtatttgagcatttggtatatccttctctaggtatatgttcttttctctcgtataactgtaaacaccaaataattggctccctcacgcttactcttgttcatctacaatctattatccacaaagcagccaggtacatctttcaaacttaaattagattgtgtaacccttcagctttctaacaaaactaatgtttggcccagcgcggcagctcacgcctgtaatctcggcactttgggaggccaaggtggccagatcacttgaggtcaggagttcatgaccaccctggccaactggtgaaacctgtctctactaaaaatataaaaattagccgggcgtgatggtgggcgcctgtaatcccagctactcaggaggctgagccaggagaatcccttgaacctgggaggcggagattgcagtgagctgagattgcgcgactgcactccagcctgggcgacagagggagactctgtcttaaaataaaataaaataaaataaaataaaataaaataaaataaaatactttaaaattttgttaaaaaaacctaaagttttcccagcttatttagccaaaatttaaacttcttaacaaggtctatactgtcctacttgagccctttgcttcagcgacactggcctcctttccatccctcaaacatatctgtctctttcttacacagaactgaggaatttgatgatcttcctgtctaaaacattcttcctcagctatcacaggggacacaatcccagctttaaaaacagttgagatacaactcctcagagtgaatgtgtgttgtcatcaaacactttgtacaatatatccctatttatttttgtgcatgtagcactcaataaagtttattattccatttctccacttcctcatttgcttatttatttagctagcacaagtcctaataatatctcctgagaaaataattttcaaaagaatgcttcattgaaaacagcattttcatatgaagtagcacatcaaattattatgtgcagggtattcactaaaaatgtgttgaattaaataatacatggatatgggaaaacaaagaatctaaacctgattaattcaaaaaataacaaaagataaagatttggagtgtaaaaaaaacttcagaaacattcttttcacattagtcaacatggaaatagattacatcaaaggaatgacaagaagaataaaatagctcctagatatatcatttttatattacactcttaacttattgctttttgcataaatattacaattgatacatgagattttatgaattataaattttaaaatattcaagtatcatttgttgacattccactaagaaaacatctatgactaacagaaatgctaatacaaagtaccaggccatttaaaaattatatgctttgttctattattaatctactcagaagtgaagggagacatttaaaaaatatttaaagaacaaatttaactctcagcttacagattagcttacatttgtttaataaacagatgactttcaaatatgtcctggtgcctgaaataaagcaggccatctataaaagtttattgaatgaatcagtgaaaagatgaattaatgtccctattaaaaaataatcaaaaaatcaaattcattcagaaaaaagtacaaatataattgagccactatgatttttaaaattctaaacttcaagtttgctacagtgtatacatgacaattagttccaaaaatgacataattttcaaccactaacatgcaaactttgttttgtaaaaatgaatcaaggctaaaaatgttggctcttgatacagaagaacaaatgtgacatattctatattctctaccactgtaatatgctattttctccaataacaaattatcctgggtagttatgaaaccaaagtttcagcacctgatttaattgtgggtgttaataagtggattatttttgacactggggaaagggggaaagtttgtagttctcttttaaaaattcccctttgggtgttaagcattttcttcaatctgttttaaagagtgaagaggtcaccaataaataactggagcctaaggtagcacagacttctttaggaaattctcttagctggtttgagaagtgaacacaagagatggctagggaaccagcttgggacaataaatagaatgaaaagaagctaatggcctcaaaatattccctaggctctcactgagagggaatgttgtcagaaggagggcccaagcaaattgcctacaagaaaactaacgtaggtctggatgcctcaccactaaacaacatggcctacttgctatggtttaaatgttccctccaaaacttatgttgaaatgtaattgcctttgtaatggtattaagaggtgggacctttaacaggtttttacggcatgagggctttgctctcataaatggattaaggctgttatctctggagtgggttatttatcattggagtgggttctggataaaaggatggagtttgcccctcatcctctctctgtatcatctcacatgcttttatgcccttccatccctctactatgggataaggcatcataaaaactcatgccagatgccagtgtcatgccttggacttcccagcctccagaactttcagaaataaatttattttctttaaaaatcatccagtctgtgatattctgttatagcaacacaaaacagactaagacactactccaaatatgattacatgttgagtaggaggaaccacttatgtacaagtcctgttgtttacccagttcttatataactgtactgaaaaactcactatgtacaagtactgtgctaaactatttttatctgctaagggggtatgattcatatttaacaaatgatcagattaagataaagaaagattaatggggacaactgctatggtttgaatatatgccctcctccaacccccaacatttgtatgttgaaacctagggctcaatgtgatagttttgagaggtaaggtctttaggagacgataaatggaattagtaccaatataaaaggcctcaagggtactagctaattaagccttttgccagccaccttctgccatgtgaggacgcattgttcagggtgccataatggaagtagaaggcagtccttccaaatctgctgatgccttgatgttggactttcctgtctccacaactgtgatacatatacttctattgtttataaattatgcagtctcagacattttgtcacagcagcacaaatggactaagaagtaagagtcaaataaaacttaactccgtatccttatacttcctaatttgtaacattggctcaaatggctccccttttaaatttggggtctactaaatcagaagttaatagcgggctgggataggaagcataatcattttatttccaagggctgatacccttgctggaatcctttgtatgtcattaagattggacgtctccctggacagattcatatggaggcaaagttttgcatatattttcagtgagttagcaacccactgaaggctcatggaactctgttcaagataaatatttcacaactgtttttaatgttcaatcatcatttatcaagtgtctgttgacatttgctttcaggtatcccttcacatttctttgataataacatcttatattttcactggagacttttcctttcttattctaatcccacagagactgtcaatgaaggaaccaagagcccatggcaaatgggtgggcacatgacccaagccagggaaatcagaatattattactttacatgtttctggctgagctatgggaaacgattctctctatctactaaggaaggtaagctggtagaatatgaaaggggtactctttgccattaattcctattcatgcagaaaacacatggaagagatgaggccctaacaaattgcttctggtcctgattctaggcatccttaaatcattcctacccttggcattttagtaatatgatccaagccccaaatttccccttttgtgccccaactcatttgaaatggttttctgtcacttgcaactaaaagtgacttgcaaatgcagcaggaaacatggaagacaatacagagtatgcaatacctaagtgaggattttggagaatggctaagaatttaccagacagacatggtagaagacttttttaggtgtgtagaagatcacaggcattttgtgtttctacaactttgtgttcctcgcactgtaagttgtttaatattcctgtggcaaaaagtacctggaaaaagttggaggaatgatgggactagcaaagctaaagtgcttcaactaaatctcaggcatctgtgtgctttttctctctggcttattgctttgtcttgatccttatttgtgttttctggttgctcataagcttataacagcctgatccattccttctaggcactctcaaacacgttatattttcaagccaatcttctaggtttcattcatatccttgcctctgtcaggttgattttggctctgacaagctctgaccctacacaatagacaactggtagtcttggcggctgggcctccagtctgcaaaattctttagccttcatttttcttttctaccagcttgaacactactatgtcttgcaacagactctcttctagctccttgcctgtgaacaactgtttttctttgatatcctggagagattcatttatctcaaaaatattcattcagcactgatgacataccaggcgttagggaaacacaatgggaggaaaaggcagaaatccttcctaatggaaattgtactctcattggggaaaataagttataaacaaacataagtagagcatatttttaaatggtgttaacagaaaagagaaaatcaaaccaagtgaggaatgctgtgaggtataatttgattacaaattaggtgatttctgagtatgggcttgaggacaagagggaacagcaatgtggatatctgggagaataactttctagaaaatgtaaataactattgaaaacaaatattgagatttataacaatatttcagggagttctttcaatgatgtaaaatgtcctccctaaaagagaggtaaaacatcagtgcaagttgatgccttggagacttaaggaaacatattatcatgaaaaaaatgatttgggcaaaaataacaaagaccattaaatatctttttatgctaaaattttaggatttcttgagggtttaataaatattaatacatttattcaacaaatattcatttgatcactgttctaagtatcacaaaatactgggaaaaatgcagacagtttccttctcttgtgtagattacattctagttaaggaggcaaaaaaaaaaaaaaaaaaaggaagcagtaggactacaataacaaaatagcaattatttatttagctcttataatgtgccagaaactgtgctaagtacattatataaatttgcttcttttcataaactttgcatctacattatcttttctttccaggtttgagatttcttggtaaaagaccctgagactattatatttaatggcaacaaccacaattgcttttgcaccaacctaataataatcaggtacaagtagtttgaaaggtgattcctggaagtgaaacattccttaaatatgcttgaaaggctgaggatgaatcctggcccatgtagttgttgctggttgtacgatcttgtacaagctatttaacctcaagttcaggttcttgttatatcaaatggagggcaaataatatctactttatattgtatttgtttgtaaaatacttagtcaaatttgatgtacattaaacacttgctatgtaatgacaatgacaataatgaattgacttccacttgcctcttcaattttatctttctattcatattgcgtgctctagcttactgaaaggcttcgatcacacatataaaaagtgccgtcttggctgtgagtttttatattcacctgggtaacctttgttcctctttaactgcctcttagtcacttagcttttaagtctttcagatgaattcggggacaatatcttcccaaggagttacagaatgccttagtaatctccagtaactcatgtcatgcaagtgattatcacaactggatgttagttttctcaccaaccattttgacacagtgccttgagactagaaactgtttctgattcattacttattctcagttcttaggacactgactgacaaacaggaggcactctagaaatatttgtagaatgtcaaaaaaaatgatgacaggctacatgaatgaaaaaaaagcatatgaggagttggaaaaattggacagaaatgttcacaggatgtatacatggagaagaaaattagttatccatatagaggaatataagaacttgaaggtctttcaaatgttcatattataggcttcaaggttaaaaaggattctgggtagagctcactggggaaataaagaaataaaagaatgggaaatactgcaatggctttgtaggaaagtcactgctctagcgtgaggaggcagataaagtagaaggcataagcaactgtaaaggaggctagcagcaggatcatggaaggacagtttaatgaaagtcatcaagagttgttttgtaaactcaaagtaataggcaatttcattgcatcttaaaatataacattaaaatgtattctcaagtatactgcagcttaggtaatatgattcacatgcattgaagcacattgtgtatttgctttagatttagaatgaatcgttgtttgtggacagaaaaatggaattctaagagtgtctaagaaactaatttctgccaatagaattttccaataaaaaaggaaaagcaatgtaaattgatttagtattcacttcattttcctttgtctttctgaaatattaatatacatgaagaaatgggagttgagaaattaaatttctaattaagaacttctagctgtaataatagctatgtcttgaacatttattacatgccccatatgaaataaaacaatttacatacattacctcatttaatctttccagtaaccttgtaaatttggtatttttattttcattttacaaatgaggcaactaacacagaggaaatatgtaatatacttgaagtcatacagaaaaagacacaacagagatatttctgattcaggtctgattccttcaaaacattttaaaaatattatgctgtaatgccttttggtaatcagtgaaatgattcattgcatacacaatttaaatatttatcaaggtcaggactacaagtttgtggtctgattgcagggggcttttcctgacctgcgttggcaaacaatttagaagatgtcttcaaaaacatttaaaaggtgtcttcatatattccccaaaataaaaaaagtcatggtttttaccttactgattattttcatttataactcgtatacagcataagcacttaaacttaccctgaaaaaaaattaactactttttaaaataaactacatctacataaaatctttcatgctatttctacagggattttcattctcatgtttttaaattaatatttgtctctacttatttaacaacttccagatagtgcccacatctaattaacaaagattcttttcatctatttttatcccaaattcaattaacaattcccagggtgacacttattgaagtctcactacaccaacacataatttgcttctacacagatacttattctacttctagctgaattccatgcttagattataatgaagttgaaacacacacacaaacaacaagaaaaaactagtaaaacagtagggatttacaatttaaacttaagcaactttcagtcacaatagtttgcatttgtatcgctatttattaattgggaaaccataaaggttgaaacacttatttaaatagaattaagaaacccaagccagtaactatttccttttctagctctgcatttggaaataagatttataagcatcactgaagcacgttaaaaccaatggagagcaacttcatgtagtctgtgcagtttgatcagcttacatgtaacattcaatttaaatggctttcattaaccatgggcagattttgaaagcttgtgacaccaaactgttccagtgaataatcaaattgctttgaggtaagaatgagaggtttgcattgtgagaatttatcttggttcaggtaaaaaaaaaaaaaaaaaaaaaaaaaaaaaaaaaatatatatatatatatatatatatatatatatatatatatatatatatgtttgtaagaatttttactacataaaatacttccactcagtcaactaatatttattggatgaataagaatattctacatttatttattttaaacttcccaccccaaatttggctgactagtactcccaattcctatacagataaattacctaagtgctaaaatttaaatgcacattaccagtaagtttctggtgaccttttaattgaaaatacatcatataaaaagtacataaatttggctatttccaaattttacatctaaactagtctttcttgtatctaaatacacatggaattcaaactcagttagtttataatgattaaaaaatcctctttaaattaatatttaaagggttttttaaaaaagaaatcttcctaaaacagtaactggaatgcaaaactgttatttttagttttaagtttaaaacagaatgattccaatagcaaaaaaaaaaaaatcaaatatattctcaggtagaaagttttgcttttttgcaggagatgtttacactatccatttaacttagaattataatattcaacaatagtaattttgacaatagctatactttgtcattgttattaacatgtaattctaatgaaaattacaactttgtactaacatctctcttctttttgtctaatcagtatttcagtcaatacattttctgatgcttgataatgcatcatttattttaaccatctatgtagttccctaataattaaaatgacaataaaataaaatactagcatcttcattagaggcatgtaaaaggctacagaatatacaaaacaatttatattggtcagaagaattagtggacattgttaaggcaagactgttattttactaggttagcaactaagagtggcataatatggaagaatagtaagaaaaatagccaaggaagctgttaatacaggaaagtgaaagaattaatccagagaatgaaagcaaacaccaatttctaaacagtttttcaaaagtgttagtggtaggaaaacacattcttaaccacttgtatgtatcactgcatgaaagcaagactcaatttagaatatatataagcagataaataaggaagggtagagagtattcattaaggtaaacagtactgagaagtgccctaccaaagataaagaaactgcaataattcagtgttgagtgctgacagtattggcagtaattgcgttaaaagttttgaatttcataaagaaaatatggtaaaatctccatcaccaaggaagatgctattgctaataacttctcacctccttgaacaagacagaaaaatcctattcaaaaagggaaataggtgtctcacagtgaaaacagcaaacagaacttactgaaggtattgattattataaagtacttctttgtacagaatggaggctatcttgattcatactggttcctcacaatcactcccacagggctctttgccctctaaagtcagaggtatcaaaatctgctaacttggtttagtttcagctaagggcataaatgacaactgactgcagtaattaattatctccccaactacaataaaaaggaaaagcaaaattaaagatactgagttaggctgagaagagagtgaatgcaaactaaataatccaatgtgtgtgtacgtgatcattttataaagcaggaaacatgctctgtgaatgagagcatttgttttcaaaagtctcaataaatatttatttttaaataaaatgaaatgttaatatatgactaaaagtttatatttcatttactttatgtatgctaagaagtataaaaatactttgagcaaacactgttaatagtattaaatttaaaaagataaatctgccctattctaatcatgtctttgtcttctgtttattcaagtgtattccatttgctttcgggaatatttggatgttttagaactaacattctgctttaataatccaaacacactataattccatcaatttgagtctcttaaaatgttacactgaaatgaatctctctgaagatggacttattgatttctatattcttcctctagcatcatgaaatttgacctcttcagccgtgcatggttaacactgtaagtatacatgtgtttttttgttttttctccaatcatggcaaatgtgtcgaaattataggctgtgtcctagatctattattttagttctattatggcaaagaagagagttttagggaaaagcgtttcaaagtgtttgaaaagtgcttgaaaaaaatatagaaagcagaaacaatattcattaatcaatcttgcatataacaaagcaagctagggcaataaaaaggatttattcatttagttcctttcttagaaataacaaaagcatactaaacccattgttctggccaattccttttaaagtaatccatttacttcagttctaatggtaattatcatgttacatttatctgtacccatttccattttatttttatgtgatttttaaatgtgcacatatcaaaataatgtcagtatgagaaggaagcagaacttaagtggtctttacacccttactattatgaataaagaaaatgagatttacagagaatagtgataattctatttgtctccaacaaattgccatctagtcagtctcactgtagacaggacactctgcctccctaaatctcagttcaattacctttaaaggagatggatagtatcatatctaaaaagaccacaatgacattaccaaaatcaataataagcataatatttactgaaagactctttatgccaaccacagttttacgttgtttgaatgtattaattaatttaaaactcacaacatcattataagttattattatggttcagccaattaaggtaaaaagaaaaaggaaattgcctatggttacaaagctagtgaatagcagaatgacttagggagaaagtaagtttcacttggtgggcgttatagctcctctttggagtaggtttgtctctttccttagccttctatttccagagtagaatatatttactggaaccaagtaaatactctatttagaataaaggtttttttatttaccacttttccttacttgccaacgctaatttctaactactcaaagctatccactttccataaaatatttcatacttttattgctccttatttctgtttttgtcagacctgcaagctaaaaattgttttgacatttttgaatagttgaaaaacattaaaagagaataatattgtgtaaattataagaaattcactttcagtgtccatgaataaattttaattggaaaatggccaaactcatttgtttacacattgtctatgattgttttcactccacaatggtagagaagttgtgacagagaccatctggctcataaagccaaaaatatttactagttggacttttaccgaagtttgctgatacctggtctagtggttcttgtctatctctttaaggaaaaaaaaactgttcaaatggatacagttaaagtcagaactataactaaaattcctgagttttaggtttatacgttgtttctaatttccttcacataagtacaaagaaaaaattacccctgaaaatgaaattatttgatagtgataatgtgttttttcacatgctattttgtctactcatgtctaaatagcagagattcagataatataatgatgttggttaatattaaaatggaaacagttgagagaacacagaaaaaaaacagtttaaaattgaatgtcaattgcattttcaatattctccttctatagaggtgaaatttatttcaccgaatttatcagtatataaaaatagttttaacttatatatttctaatataagacccttaaggaaagcagtttattctttggttactgatatgcccttgacatccaaaacattgcttggtatccaccaagtagacagtataaagtactgattaagattatgatttgtgcggtagaattctggttctaccacttactaacactgaaattaaaccagttgctcaactacgctctgcctcaattttcctatctataaagtaatgatgtttgcaacatcagtctgaaatgttattcatgaaaaaaagaaaatcagttaaaatatataaagtacttacaagagaacctcacatgttgtagggaatccataagtgttattattgttgtttttataaatatttattgaatgaatgttcttacaataaacataaagtctcatgatattgcccttgtatacacgttttgatttaatcatgttacatggtattcatttttttctgtttttttattgtaataaaaattttaacttttctaagatggaatcccagtttttcttttgctataccttgtattgtttgaaagatgtcagtgtattatttcaatacaaataatatttcattccctagttataatttcactttttatatttaactcatttttcaccttatttatgttggatattcaagtttgagaaggaataaagagtatatacatgacttctggatataaattagctttaaaaatgaagtggtttggccatgtgcatttgcatccatatccaaatccatagccatgccatatgaacctgcattccagacctagtaccaccattgttcgatgtatgttcacagttcagacacaggcaccaagaagaatcccctctaccacaacttctcctgtgggtgaaaaggaaagcaggaggacttcaaaagctttcatgactggggaccctgcaagtcattgctgcctttgcagacactctcagccttgtctactaaaaacgctgtagtcttcaccagtgctgacctcagctgatggaactacctggagtctaactgctgcccactcctggagctggaacagccactgtgtccttcagagaagaagctaccatacccacccagttggtggcttcataccttcccataggtgaggtctttccttactgaagccagtacataaagtttaaagaggtgacaactccttcaaatgtgcagacatcaatgcatgtctatgagaatatgaaaaatcaagaaaatgccacaaaaggaacacaataattttctagtaactgaccacaaagaaatggagaataataagttgcctgacagggaattcaaaataattattttaaagaagctcagcaagctacaagcaaacacagatacacaacttgaaaataatcagcagaacaatacatgaaaaaaataaaagttcaataaagaggtaaaaatcataaaaaagagtctaacagaagttctggagctgaagaataaaatgaaaactacaatagagtgcttcaatagcagacttgatcaaacagaagaaagaatctaaaaattcaaggacaggtcttttgatcttaaccagtcataggagagaaaaatgaaaaaaagggaagaaagcctatcatatctatggaacaccatcaagtgggccagtttatgcattatgggagtcccaaaaagagaaaaagaaagaaagaaattgatagaaagcatatttagagaaataacagctgaaaaatccccaaatctcaggagagaaatggcatgcaaattcatgaagctcaaaagttcccaaataagatcaaccccaaaacactgcaccgagacaaattataatcaaattatcaaaagtcaaggacaaagagattagaaagccaaaagaaaaaagcaactcattatgtgaaagagaatccctgtaagactattagtagatttctcagcagaaacattgcaggccaagagacagtgggatgatatattcaaagtactgaaagaaaataactgtctaccaagaacaatatatccaacaaaattattctttaaaagtgaagaagggataaagtctttccaatacaaatgaaaattgaaggagtttttcaactatagacctgccttaaaagaaatgcacaaggaagttcttcaaattttaacaaaaacatgctgagtagcaacatgaaagcatgtaagagtataaatctcactggttaaggtaaacatacagagaaatggaggttaaagtaacattataattgtattgtataaattacttttaatcctactataaaggttagagatacaaaattgttaatggatacacaatataaaaagaaactctaactacaagaacacaaatcgggcagagtaaaaaggggagtaaaagtgtggaggttttgtattcaattgaagttaagttgctattaacttaaaaaagactgttgtaactacaagatattttatgaaagctttgagctaaccacaaataaaattcccacaatatacataaaatatacaagaagaaaaaaaatcaaagcaaataactacaaaaaaccatctaattaaaaagaagacagtaagagagcagagagagaaaaatcaatggcaaaatgtatagaaagcaattaacaaaaagaaattagtaattcctcacctgtcaataattactttaaatatacatgaattaaaatcaccaatcaaaaggcatagcatggctgaatggatttaaaggaaaaaaataatataacaagatccagtggtttatttttcataagacactcattttacatataaagacacacacagtttgaaaatgaggagctgaagaaagttatgttatgcaaatggtaaccaaaagaaagctaggggtagttatgcttatatcatgaaaagttatgccatgcaaacggtaatcaaaagaaagctgggaatggctatgcttatatcagacaaaatagactttaagtctagaactgtctctagaggcaagaaggtgattatataaacaggtatatatatatacatatatatatacgtgtgtgtgtgtatatatatgtgtatatatatgtgtgtatatatatgtgtatatatatgtgtgtatatatatgtgtatatatatgtgtgtatatatatatatatatatgtcattttcatgagatctcagatgaaaacgagaaacaaggtattggaaactaaagtaaatgccatcctgttacacctctgcaaagactagtagaattgtgtctatattattggactttatggaatgaagaacttaagagtgaggaactatgatatctggtgaaagaaatatctaagcagcaaagcattcaccctgctgcatgactacttttaactgtttacagtgaagtgtgacagaaaaggattgtcttaagggcagaatttataattaaaaggaaagcagagtgaaaaaccttggaaaattcacagcatgggaaggtaaaatgtgaaaaaatgtggccaagcaaccatttgctaaagaaattactacagatggaagggagtcaagggctactctttaagataaacaagtcacttcttacatggacggcagcaggcaaagagagagctcatacaggagctcttataataaccctcagatctcatgagacttattcactatcacaagaacagcacaggaaagacctacccccatgataaaattacctcccattgggtccctcccacaacacgtgggaattcaagatgagatttgggtggggacacagccaaatcatatcaccactcattaggctctacctcccaaaactgttgcactgggattaagtttcaaacctatgaacttttgggagatgtattcaagccatagctttctgcccctggttcccaaaattaataaatttaataaaatcagacatgaaagaggagacattacaacgaatgcctaaaaaatataaaggatcataagagactactatgaacaattataacccagcaaactgcagagccaagaaggaatgggtaaattccaataaacatacaatctgccaatactgaatcaaaaagaaatagataatccgaacagaaaaataacaaataaggggattgaatcagtaataaaccaacccaaatatgtccatgaaccaatgccttcacagatgaattctaccaaacactgaaagaggaattgataccaactcatcttaagctcttccaaaaaatagaagaagcagtaacacttaaaaggtcaggatcccctaattccaaaatcagagatactacaagagaataaaattacaggccaatatttctgatgaacaaacatgcaaaaatcctcaatataatactagcaaacccaatgcaacagaacattaaatagatcacatatcatgaccaagagagatttatctctggaatgcaaggatagtttaacatacacaaatcaatcaatatgatacaacacatcagcaaaattttttagaaacagaattatctcaacagatacagaaaaggcaaatgaaaaagttcaacatctatttatgaaaaatattctcaacaaaattggtatagaagaaaattacctcagcacaataaagatcatgcgggaaaagtacatagctaacatcttaatccgtggagaaaaactgaaagctttccttctaagatccagcacaagaaaaggatgcccacttttactacttctttttgacatagtactgaagtcctagccatagcaattagacagggaaagaaaataaaaagcaaacaattggaaaggaagaagtaaataatctgtatgcaaatgacatgaccacagacataaaaaactgtaaaggctcactgttataactaatatctattttaactaataaacaaaacagtaaagttgcagaatacaaaatcaacattcaaaaattagttgcatttccacacacaaacaacaatataaaaaggaaattaagaaaacaacccccttaataatagcaatgaaaagaatcaaatacttagcaataaacttaatcaaagtggtaaaaaactttaaaatgtattttaatatctgtgcattctagggaaaccccatactcaacaatcttttaattttcataacattattaaatgttttacattaatatttaataaggaaatttcagaattattttatttaaatctcaaaaccattatattagaattttgattgaattacacctataaaataacttgggaaaaatagatatctttacaatatctagctccagacacaaaaatgaaactgttgtttccatgtatttaggacattttgtatttcctaaaacaatgggatttgctactttagctaaaaatttctaaacataattcagtgtttacatataaaatacatctatatatctatctttatagttatttgaacgaaatatgcttttcactaatgctttctatttattgctggtgtgggaatactactgatatttacatatacatttttatattactttattaagttcattaataaattccaaacattctttatgttttgtgtgttctagagtctgctttttgtacattaatattcattctcacattctttagcaatagaacttttgtatatggccatgaaaatagagattgcatgtcctggtctcttttacagcttagagtgatgtgagaccaagttttcttcaatggcatgtaagtaagagtcatgtgtgctacttcctgatctcgcccttaaaagttttctttatatgtttattagctccctataatacctgctggctggaagtagtgccatctgtgacaggcactttaacccatacagcgtatttttatgtccctcagcccacttgttctggatacaacagacatatcagtgcaggtgcaaatccatctaattccatggatagatacaaatgtatgcttcttggaataagtgttgattaaccaaaacctggagaaaagattttaaaaggagagattagaagaaatgaatacatccaagaaaagggaaatggctcaggcatttactaactatgtaattcaggtgaattactttaagcattagaaccatattttctgcatctttaaagtggtgatagtactccctgttttaaaggtgattagataatcgcaagatctcaatacattttcactgttaataacagcaataacctcgtaatgtggggatccatcaacttgaaggtagggaaaggtaagtaagtggttggagctttctgagaacgataaaacagcacttacataaatatacttgactcagccttatgcctcaaaaacaccagttgcctttcccaaacttgctagtgacagtattttatttttttatttattcttttttgagatgaagcctcactctgtcacccaggatggaatgcagtggcgcaatcttggctcactgcaacctccacctcccaggttcaagcgattctcctgcctcagcctcccgagtatcggggactacaggcctgtgccaccatgcccggctaaatttttgtatttttatgtatttatttacttatttttagtagagagggggtttcaccatgttagccaggatggtctcaaaggtctcgaaatcctgacctcatggtcacccaacttgggctcccaaagtgctgggattacgggcgtgagccactgcacccagcccctacagtattatttaattgttttgtaattttcttttaaaagactctctctctctctgcactggctttacaaaacttccacgacacattttctgattgtactgtaagttattttcttccttatctcccaatgacactgttttctacatgaaaaataccattttggctttatcaacatgttattaattcataatatgagagatctatcagcactatttgtaaaaatattcaattaaaaaaattaagatgatttatagttgtgtggtaaagaatttgaccttacccaaaggaggtcaggcttttgccctcagccttaaggagataatcttgtcatacccaataaaagtgttattttaaagtgaggctgactacacctgataatccagcttgagggacagttatgccagtttgaccaactagatgatttagggagctttctctcccaacttcaaagctgtgatgaatcaaacaggtaattaatcgatcatgcttatgtaatgaagccttgattgaaacttcaaagattgattgacgttccttggttggtaatactctgtcatgtgtcaattctagaagggtaatacgtcctgaggataacagaagctctgtgtttggaatcatcctggactctgcactttgtttctcctgctttggctgattttgatctgtaacctttacctataataaaccataactataatataatagatttcagtgagtgctgtgaggctttctagtgatttattgaacctaagggtggatgtgagaatttcctgaacttgcagttggtatcagaagtgagggaggtcctatggaggactgtgccctcagatgttgcagtttggctaaactcaggtaatagtatatggtaaataccaactgatcaagttatatttgttttttgctaggaagttttttaaaagtaaaatcattagcagtcaattatcaattaaaaaattaagtcaattaatgtatatctttttcatccatcttatttatttatttatttatttatttagtgttccaagagttcagttatttggaacttccacagttttcaagacttgagagctattgcactttcttgttaaaaatgacatgggaacaaataggtactgcagaaatcctttcatcttgtttaatatgacctgaggtgtcacattttctatatttaaaacatagtggccactgcaatgttctcatgctatttattactattatactgaagtctatactgtgatataataatcaaatgtatcttaaaaactgtaaatatctggatgctttaattaatcttttatgtatagttaaatgttaaattttatcaaagtatttggcatttttaaaggtagtttaatttgattaattgattgaatacatgctttattgatttacacattttatgtctctttcagtgtaatggagttataaattttgagataattcatgtatatatactagatatgaagatatcatgatggattcaaattactgaaagatgaggaaactataccagttttatacaggaggaaatattgttgggagaaaggccaggtgacatagtaactacaccgaaattgaaagtcagacatcttggatttggattcctgtcgactagtgataacactcagaacaattcacttaggttctatatgactcaatttcttaactttcaaaatgctagtaataattatccttttctcatacattaattatgataactaaaaaatgtgtgtgggttcggggtattgttacagtccttactgtagtaccaagcacacagtaacctcctctaaaattgcagatgctattatttttatcaaacatgtgaataagtgaaatgcaatatcatttataaaatgcatatagtgctacagaattattctatgaacaaataaggtatttgtttattcacaagaagaagatttcaaaatacaaaaaaaaggagatgtagtcgtgggtataacataaagtacagagtactactatcatttcattttttatcacattcaaagtatcaacagaaaagtattttcatttgctcaactaataactaatgtttacttttgagtccaataatagcaatacaacttcagtatgccaagtttacaaagtgcttccctgtatattgtctcatccaaatattacgacttctttgaaagatacgtccaaaatttactaatacattctatttcatggatgaaaaagaatgaggcactgagaagttgaattaattgccaggtgctatggaattagtaaatgatagctctataattcaatcttgaatcttctgacttaaagttaatattctttaactttttatcttgcctctcaccaaagttcaatatttcatctaaatttctaagcaataagtaatctttctcaaaatgttagcttaaaaacaataagaataaatatgggtaaaataaaataggtcaatttatgatgcttatgatcaaagtattaatatcaaacacgatcttactattaatagagaaaaaaagcattcaaaatctccacatgcaacaatagaactatgtctgctaccacaaataaaaaaaaaccttatgctctcatcaaagaaaatattctaatcaaaataggagagagtctggaaagatttgcaaacaaacttcaaatgtcttatacacagtaggtgacacttttaacttctattttagataattgcttcacacaagacttggaactagtaaaattagtggaagtagcaaacagcaattttgttacctatcttctttgttggattttaacaggtattgttataaaacaccttgattttttttgtctgggaaagattctttgtattataacagtacaatcatcaacagcaaaagatacattttctattcatgataataacttggacaatttacagtttattcatttatctttataatacaatatcatcataaaggataatcaagaggtacaataagaaatcataggtctttgtaaataactactggtttaacaatactgaaacttttagtttaccaatctaaaattaaaaaaaaatccattgttcaaccattattcaacttttctaggaaattaaaatctatacaatcttctaaccaaaaatgatacatttccaacaggaataatacgttcccaataagtgggtcttttggaatctcacaactgttggcaggcaagctaaaagcatagcatcagacagttttgcattatctttaaggaatataagttcagagctccaagggtgtcactgtcctatgcaaacactgttgtcattaaacgcatactgtcatctggtaagtttagtcatggcgacttgtttcaattgttaataaaacaaacaaacaaaaaatctcttttatctgactttctgttcgaatgttaactgaaaattggtcatggaatttactaatatgattcctaatgtttaaaataagctaatcagtggaattagaatatgtagcatgcataaacatgtggaaaattagaaagtcattatgagagtaatcatttttataaagcagtgatagacatacaaaattaaatctgctttcatctcccagaactgaggaagagatagaatttaaaaatacaaaagtgagtaatttgcaaaggcccctcaaaagaaatgattcttatttttaggattctgaaataatttaacttaagagattttgcagtggtctctttttctacatctggagctttctactcacagatatggcagttttaatttgaagagaaaactgacttagtcacttgattaatttttcaaataaacgatcctataacttcagatgagtatttctattacttccctctaggcaaattccttaatagagtattgttcagcaaatctcctactttctccatgtttttctgcataattatcagctatttaagtttcttttaaactattcaaatatagctgaactactcatggatttcagaagttccctaatttttacccgtgtcaaattttagggaaaagttataacactgattttattctaagtggccaaagcaatcaaagacaactttagctcaatatttgtatctcttccttttgaattatgatgaataaaataactttatagatttaaataaggaaataccattggagaatccatgttgtttcagttgataagagctgtgaaatactggcttttatttaatttgctggggtaacttaatgagaacctcatctgggtccaccatcccatactaaaatttattcgcttagtcttattggttccttgctatgttctatgttgtctcgtttacagtctccttagttcctaaaaagtaactctgttctcactttccttagcagataacccatctccttgagaagaacccctgatgaaaaagaaatcctctccaaatcaatatcttcattcatcactacactacatgttctattttccttcctccatttctcagaggaaggagttctattacttgccattgatcttaaaattatagttatcctccactgtgctgccatccataatttcatgtccttcatttgtggctttgttttcaatggctataagcattttcaattttgtcccattataacaaggctgtcactcaatactgtctggaatcattcagcatataccctctccttcccttcgttgctgaatttctcaaaagagtattaccttctttcatttatctgaactcatacatacttttaatcgcagctattctactttcattagagtttactgcaactatctctgtaaacatttccagtgacctcttaagtataagtgaaatcatttcatatcagacataatcctccatgccttcaagaaacattgaacacctccaatctttatgcttaaaactctctctctctctctctctctctctctctctctcaatatcttgctatctcactacttctatctctaatttggttcagtgactcttgacttgcttgagtctcatatctctccttccttcattccagccttttgcttttagaatagcttccacctttgcctgtatctattcaccttttccagttttccatttaattccatgcatttaacagaatactagttgttaacctaactcaaaggatttgggggatgattacatggaataatgtgtatgatgcaatggctatgatccatgggcctgtaatgcccccaaaatgtgtgttgctgcctctatctcctttcaacatcctgatgcaatatttttctaaatgtgaatattacttaatacgcccatgcaagttctttaatttttccttaggaaaatagacttcagagataaagctgattgtagatgaggtacaataattgttaatttccttggaaaattctaattgaaaattggtaaattcagtggttggaataagtatgcacagagtaaaggcaataaaaaatatagttcagcctgcaactacacttgccagttctttttatgtataatgtaatcatgtggaaaggcttttaaaataagcacgcctgtgtattcactgcaaattagtctgtcaattgaatttttacaggtgcttctgaataatccatttcgtctggcttaattacataattttaaaagtgtacaggtttctgataaaagagaacacattgttaggatgtaatctatttattaccccttgtacttccctttattgtgcttttttttggctttccaattttaagcaataacaataatactctgcaaaaaaataaagactttattgtattttctgtgtctaaattgtctgggctcacttttttaggacaatggcctggaacatgtaatcaacattaacaatccaatctgcctaagtggggccattcaaaaaggcctaaaattacaacacattttcattatgtatatatttatttacaatattttgtttgatttttaaaatttatatttgccattactaaaagaacataagaaatgccacactaaataatacctgtggtctactcaatgctgtattttctgacactgtccccttgattcttttaagatcatgaagattcttttaaatctatccttaaacacagtaccttgaccatctaatacatttcttacctttaactttttgagataccactagtctataaaaccgaaaatccaatcacatctcttctcttcctaaaaattctgttggctcactgctgtctgcaggacaaagcccaactctagccacccctcactcagatctgcctctctctgtcacctcctccccaatcctacctctacctgcttctattttctttctccaagtccatctggtgagctctttatagtcacttttgtagcaccatctgtttttcctattcatacccctacaatgaattcctccctttggtaatattactaaaccttgtacctacttttatattcacattagtcatactgtattataattatgtttactgtgataaaacaagataaataattagttttttaatcatttttaagtgtgccctttaagtactactcaatggcataaagtacattcacattgttaatcagccattaccatcatctgtcttccgaacttcattcatcttcccaaactgaaattctgtacacattaaatactaactcttcattataattgctttttaacaaatagatagggtctcgctttgttgctgaggctggtctcacactcctgagttcaagcgaccctcctgcctcagtgtaacgagtaggtaggatttcacatatatgccaccacacccagcttacaattagtttttaacattaacaggtctatctcacatactggccttcggagcagaactaactttttttttttttttttttcaatacagagtcttgctctgtcacccaggttggagtgcagtggcgtgatcttggcccaatgcaacctctgcctcccgggttcaagcgattctcctgcctcagcctcctgagtagctgggattacaggcacgcaccaccatgcccagatgatttttgtatagagactgggtttcaccatgtaggtcaggctggtcttgaactcctgacctcatgatccacccacctcggcctcccaaagtgctgggattacaggcgtgagccactacgcccggctagaactaactatttacaaatatgagtttgttaacatatttatacccagtacttaatgaaatgcctggcaactggaagatgcccaataagtatttgttaaagtaccatgattagaatcacatattatattattatgttaaccaaacgcatcaaattatgccaactttctagctctttgccacgtcagccttacactttacaaaaaacaaacattaacaaaaaaaaccacacaaaaacatacctttaatggttttcactttaacaaaaattaaaaaaaaaacagaaaaaaacccataatattacctttagtgctttctcatttcagaaagcataaaatctacaaatttttagctcttcagaatctggatcccatcaacctctttaccctcctcttctgtatcttttcacaccctgacttttatcaatgcaacattccttattcttgaaacagcagtttcagattttcttaatcattctgtctcctcagcctgaaatacttcccacagttttgaagttaaatcatagccttccttcaaggatatactcaaatgctgtctttttaggttgaagtcttctccgatcctttggcacagaatacgcttattctctgttcccttctgtattttgcttgtgcctgtattttgtatttagttagttttgcactaaattacatgttagttatacgtgtatacgtctgtctctttcactagagggcaagttatatgaaaatttacttaatacctcatttattttctttctttccatttcttcctttcagagactctcaaaattttctgcacatggtagagattaattaattaaattgaaagacgaaacaacttgttcatttgatacatatgatcaacatattgctgtttattgagcatactgaatgttgttcaaatggttcattaagagaatagtcaaagaacaacatgaaaacactagtcagaatgaagtgtagataatgcaatttgacaaacatatattgatcaagaggttcatatcactgttactgagtgaaataaatataaaggagagagatgaagtctatttctcagtaaactaactacataggcttacacaagtataaaattaaccctaatacttgttgaacagtcgtaatacaggctgaagtaatgagctttagccattaattaattagcctgttggcaaagaattataaaatagttcattaaagaggtgacatctgagcttgagcttaaatgaggaaatatgttttcaatgagtgatttggggttatggaggtattccaggaaagactttagcataaataagatttagagttaggaaaaatgttgccttctttaaaaaaaaatacactctatgacttaaggccttagaatgactcaggcagagcagtaggggtggtggagttaaagtagaatctgtaggttaggaacactgaagaaattttcgatggtatgttacaagtctatgtaacatatatcactatattgttaacatatattaatatagcataatagatcattatgttatcagtgtattaatatggcatatatcatatataagtacatattatagatgagaacatattacaaaaataatcattataattggggcttcacttagcaagtttaaccttgcagaattacacagcaaaagagataagcaataagaacagataaaagcctactgtaatatgtcaggtgagaatgcatgaagacctgaaatattgtaattttaatacatatggaaaaagatgagagtaaacagatatggggaacattatagacacaattatatacataaattgaaacaacctgaaagcagagagttaagacaaattcaaagataaatacattttcaagtaggagggaatagcagtacattaggagaaataacttctctggtctcatctgtaaaataatagtatgtaccttccagcattagtgtactgacatatatgtatttagcaataaatattaactatgattactattaagtgctccataaaatgatctagtattgatgtcattatggacaataaaatctgactctaaaacaactttattattttatttgtttataagaataatgaaaagttattaaaatttcaaacactacagaaacatatggtatatatacttgcaaacaatggagaaaacaaataataacagtttggcacttatatctaaaactttttctattcctgtcataatgaattattattattatttatatttgaaaaatattgagattattctatgcaacttcattctttttacatagcagaatgttttggggctttttccagaaaagaacatatagtagttttgtattctttttaatgaggcaactcactttattacattaatgtgccatatagaatctaagaggacatcaggaaaactaggtggcatttctgacccaccagagcataaggcacttttgtgtaaattagaaaatgtactccttgtaggtggctatgtcctctggtgcatgtctggattagcaaaccctgagctatatttcagctcccactgacctccctgctggaaatttgtaggagagaataatctatacaataattaacaaagccctgtggcaatgccaaagggatgtttgaaattttctgtagagctcagaagagtatataaactttgagctatagattttagtttcttttctacagaagtcatggttgaattcctggatgtctggggagaatagatgagcgatcaatgaaagagattatataaagaaaagatattaggaggtgataactccaaacccatccgtgagaataagacaagtggtggtggtgggaggaggagagagagaaagagagagagagagagaaagagactctatatataataatgatagatagatgagagaataaagcatattaaaatcatataatgatgatagaataaactgtatggtcttttcagattctacatatgcatatatgcgtatgtatgaatatatcaagatatcattcacaatctaaatctcttctcttaattatccgttctgaatttgggaattgaattaattcagaaaaaaatgtttggataagattttatatctaaactgtcactgtaacaaggagaaactcaagaaccaagcagattatcataatatagcacccttactcttcaagatggcaatatgaactcagaaaacaaatagatttgaatgttaagggacacttgtaaatacattttaaatttaatttaaaatctgaaacgttgctgggtgaggtggctcatgcctgaaatctcagtgctttgggaggccgagttgggcagactgtttgacccctggagttaaagaccagcctgggcaacatggcaaaactccatctctataaagaatacaaaaaaaattggctgggcatggtggcatgcaactgtagtcccagctactcgtaaggctgaggcttgaggatcacctgaggctaagaggtggagggtgcagtaagccttgatcgtgccactgcactccagcctgggcaacagagtgagaccctgtctaaaaaaaaaaaaaaaaaaaaaaaaaaaaaaaaaaaaaaaaaaaaaaaaaagttaaatctgatgcatcagataaacgtttctccagctccttgctcatttagtcatacgcaggacttttgctctggttcctgattattcggctcttaataattttttaaactttttcatgaaaatttgctctttttttaaaaactatcttcttcagttattgcctccaacattcaaaagtcacctagttcttatcctaaagctgctaatagtatgaatttttctaaatgtattttatcaggtttctaaatatatcttcttatcatcaatacatgatgctttacttacagtgatttcttataccaattgctcttactatagagaatcaacaactcaaactgcaagtgtcttctgattttttcgtaatttcattttgaaatatcaattttattaagaagttaaagttgactcttttctaattactctcttaaaagaatcactattgataagtgatttattattagaaaactaaagtaaattttctttatcactgggcttgtgaatttctaaatagggattcgagttaagccacatggacaatagttaaaatcaacaacaaaaccaaaatggaagttaataatgagcacgataattactaacagacgtgatttttacttatgcaagtgactcttatttgtacaaatgattttaagcaaaacaaatggcattcagaaaagtctgcagtagatacacaggagtgctaaaaagtaaaaatttattttatctatgtaaaatcaatcaaatgtaccacactgcctataggagattataataatactcgagggataaaactctattccagaaaacagtcgtaaatctttcctccacttttgttctcaagggctgctgttcaattttatgtataattgaagtaactacttagttgctattcctggagcaaattttcagagcctcactttgagacagagtctggctgtgttgcctaggctggagtgcagtggcgcgatctcggctcactgcaagctctgcctccagggttcacgccattctcctgcctcagcctcccaagtagctgggactacaggcacccgccaccaagcccagctaattttttgtatttttaatagagacagggtttcaccgtgttagccaggatggtctcgcttgatctgcagacctcatgatccacccgcctcggcctcccaaagtgctgggattacaggtgtgaaccaccacacctggcctatgggacacttttatttcagcttactttagccaagtggtctcatcacacctttgtttatgacaaacagaaattctatcacgttcatattaagccatgcttttataatagtagccaccaaactttttgtttgtttgcccttatcaataaaatattttgagaaatgcatccaaaatgaatgtaattttatcacatataaaaatcacaattaacattaataaaatataatatgaatacacattttacgtttttttctgatagttccaggaacaagtacaccccatcctgaagataatttatcaaccccatctctttcaaagactgtgtactccttctcattacctattattccagaggttcttttcttctatgatgactgagaggtaccaatctcttatttcttttttttttttttcccccaaaccatcctgtttactaagctgaatctggtcatcaaaaagttttctttcctttttaaagatggctatttcatcatttatggttttaacactactagcctttaattcacatagagtttactctcctactagctgaaagtccattatttctaaaggttaaattgttatggctgggacaaagaaaagcatatatacactcatttaattaatctagcttattttgaagaacaaaagagtggctgggcgcggtggctcacgcgtgtaatcccagcactttgggaggccgaggcaggcgaatcactaggttaggagttcaagaccagcctgaccaacatggtgaaaccccgtctctactaaaaatacaaaaattagccaggggtggtggcacatgcccgtaatcccagctacttgggatgccgaggcagtagaattgcttgaacccagcaggcagagagaggttggagtgagccaagattgcaccactgcactccagcctgggtgatagagcaagactccgtctcaaaacaaaaaacaaaacaaaacaaaacaaaacaaaaaacaaaggagtttgtactgagaagatttattgagtggtttgaaaatgtgtatttgtctgtatgcataatgtatatgtaaacattatcttgttataaatccctttataagacttatctttactgatattagcctcatatatttttataaatctatttatatttacttattttttattgatccataatagatgtacatactttgggggtacttgtgataatttgatacattcatataatgtgtaaagatcaaagcaggttatttggagtatccaccacattaactatttatctttactttttactaggaacatttaaattctgtcttctagctattttgaaatgtatattagattaatgttaactataatcaacctactgatctagatctatggaacactaggtcctatttcttccatctaactgaaaatttgtacccattaatcaaccctcttcattattccctcccctctacccttggttatttaagagtaagaagattttgctaatttatattagtatgtccaatactagtaataccaatattacattactggaataaacttgtaggaaaaatgcagccttataaatgtcagagaaaaagagagatgggactattttaatggctgacacaggttaaacttctctctctctctctctccctctctctctctctctctctatatatatatataattttattttatctatgtaatatcaataaaatgtaccacactgtctataggagactataataatacttcagggataaatatatatatatatagttttatatcttaggtattatatacatacatatttagagagagataaatatagatagatacatgtatatataaacaaatttatgtactctctatatatacctaattatccaagataatttgtgcgttaaaacccaagagaagtaaaatcttccgaagataaaataactctttaaatcttaaaaagatgattgaaaaaacttttttgggggttgtgaatagtagcagaagtggattcagtgacgtcactaaatatgagtacagtgcttttagaagataagaataggcaggacctgagggcaagtatatctctccaaggagttcacttttatttgtagcattttctaagtttaacagttatttgatatgtgttccaattttgagctgtgttttccttcttgaaacgactgacgttctgcctgtagtctttctaaatcttcatctccctagctcacatgtcactagcttttgataattttcctttggtctagtagtgacacatataaataaccaaaaatcagaaaacaagactccggcaactaatttcaacaagccttgttcaatggcatagacagaatgtaatttattttttgtgacagttataataaaagtgacgtgaaacacaagggatgtaatgtcagcgatattgcacctcaaaagaggagaaagtgtggcaggttacctcctgattagcagcagctagttcttcttccagtgcagagactctttctaaagaaaccctcagtcgctcccttacctagaagaaaaatcaaaatatgtgcagtaatgtacatcccatacatattaaactgtgctgaatccataattaacatcatcagagacagtcaatttggcaaattattaaagtatttatatccctgcgtgctcagaatactaaatctggcagaaatacaatgaatgcattgtcacctcgtattgtcactgtatcaagggatttccttgtaagcaaatgcttttggtagttccctgatagagcttcaggtggggttggagattgacttgtcttgctctgaattctgattcatagtaagtggagacaaagtttaaaagtatattatgaattcatctaaaaaatagtcactgtttaagcatgacaaataggaaaaaaaaataccccacctttttctctacttctgtaaaataacaagtgaattttcatttggtacttagtatctaatttcaaaaattatttgcctgaaggaaaggccttttagaacctgaaaaatgttcttcgcttctctgttttttattaattagaggtctactttgtttttgaggaattgtaaactacttaagtatcttggaatttccaactagcttccagataccaaaggttaaaccattgtattttatagaacaaaaatctctgtatattttagtttgaaagtcataatttatgcttgtttcttacataactgaaactcgaagaagtatttctttgattcttgctttcttagaactttgttttagttgttttatgtttagatctatatatatgtcctgatatatatatatatatatataaaacaattcagagaaagaaatattgctgaattaaaatgaatgactatagcagtttaattttccttaaaaaatcaaaaaactttatagctttaacttaagatgcaattcatggtgggttttcgattatttataaattaacttagatttttcttgggaatgctatagtatttgtgcagttaagatgtgttttaacatataattatattcctatgagctttcattttattaactgacagcatattttaataaatggtatttttctcctctaataagatttaactgggaatatagattaaatttataaaatatgtaaaaacccagatacataaaaattaaattggaattataatattatttttccagttagcaaacaaacaaaaagtcagtaatgtcctattaacctagaatcctattaggaatttttaagaatctaagtcacattttagtattgtattacaataccatgtatattcagatgaatggatgcatttaattcctgaaatagaccttgaatcagcaataaaaatatccaagtaggggttttaatattaattatattttgttatgcttaaattctctaaaaacaataatacacacataaatggagacttgatttctaaaagagttgcacaggatctttcatcatattgagctagagattaactgccaagtatcattcctgttagacaaatatccaattgttaacaaaatacataggattaatgctgattaataaccaaacactagttacatagcaggaaatcttcgatgatttgatttggagaatacttttttatgaattttgaatacatgaaaaagaagcaaatatcccgaagccatgaaaatgagcaggacagctgatgtgtggaatgcatatatcaaaaaacgtttcaacagacgtgtgatgtttaacagggattcccatattctaaaataccaactgtaaaatacgggtgtcctgaagaaggcctagtaaacctagttgatgagaacagcaatatgaagcaatctaaatatgttaataatctctccatacacaacgctgatcatatcacacttaagctgctgtagagagaggaagttaccatattttaaaatatcaacacattaaaatctttctaaaagtcattcgcataatataagaaatggttgaatctaggctacatggtaggttaatatatctttctttctttttttaaacttaaactcttagaactgttccaaactgttttctatttactacaagttaagcatttatattttcattatagtgagtttttaaggagtaaaagttatcgaatttatccaacaatatgaaaatgaaataatcatctttcatatatttagaatagtggtttacaaattgagattatgttgtccacgaagtaataaatctaaaactgttttacaagaaaataaaaaattctgaatatattttgagttatgttataaattgaaaaattgatgctgtgaatatcaataatgcaaactgaaattaatataaggcagggttgcatttggggaattatcactcctacaacagaaaatattcttgtggaaatctcctcagaccagaagctctaattcattccttgacactaagatatttgataataaaaatatatagggaaggcatatatatttaatttgttttggtttacatttcccatacatgtctgatatgttatttttaaatagtcaatgatttctgagtaattgaaaaacacaagtatatttctcatgttctccaacccttggaattggtaaatatattgtagagtaatttcaaaattactgatggtcttagctaattatgaatattctatgctacaacttggtggctgtataaataattggacattaatgatgaaaattatgaatcactgcaactctctacagctatgctcaatccttgtagagtttatttagctctgcatatgtactaatccctctatgataaagttgtttgtttcctgtccccaaggcatggttaattgcatctttttctgacttcatatatatatatatatatatatatatatatatatatatatatatatatatagtattacttgtttatatatctatatccacatccctcctcatccctatgagaaactgtgagttactcttagggaaattgtctatgaaggcacttagacacatatgagtccctcgacaactaaatgaaatgctattgtaaacaagcatctggatcaacagtaaaaccaacatgtttacttggtttgaaagttttatcaaatgctgatgcttactcctgctaataataatattcataaacgttcactaaggacttgccatatgctaagcactggctgaaagctttgcatatcagatcatatctaatcctcatgatgactctgaggtcagtactaggattatcttaattcaagataagaggtaattgatgctttgagaatgaatgatcaagtcacttatccagatctgtctgactccagagccccaattcatttcttctttaggccactgagcattacttgttgataatcagtccagttgtccctgaactcaccaatgttcagaatacctatggtgagttaatacatattattatagctcctagggtcatacgatggaacaactcatatagttatgctaaacccactgaacttctataaagtaaattatttctagattacgttgtacaacaaccatttttttcttaaatgtactcacacgaccaggttatttgtcttaaatgctgtttattacctctattctgataaagaatcattcttttgtaaaagcatccctcaagtgatatgggaatgcttatgggaccatctcaaatcatacattctctagtaccttcatttaagtcacaaaactcttgaattttctctggataggtccttctcttcttacagctctgggttattttctgtgtgggtcctgctgcttagagtatctttctctgcttaaaaaacccttaatcattctttaatacctagatcaaatgccaacctttctttttttttttttttttttttttttttttgagacggagtctcgctgtcacccaggctggagtgcagtggcgcgatctgggctcactgcaagctccacctcccgggttcacgccattctcctgcctcagcctccccagtagctgggactacaggcgcccgccaccacgcccagctaattttttgtatttttagtagaggtggggtttcaccgtgttagccaggatggtctcgatctcctgacctcgtgatccgcccgcctcggcctcccaaagtgctgggattacaggcgtgagccaccgcgcccggccatgccaacctttcttgaagacatccttgtctttgtcattactcacacagtcacagctttttctgtggctacatattgtgatggaaatacatctgttttgagttgtttttcattgatatgtgaattcctagcactaactctgaacttctcagtcataatgagcatatcttatttatctctgtgtgtcaaacatgtgctatggagcctgacacatactaaaaattctatacatataaactcttgcaaattcttagcacttttataaaaagagaggaaatataatatgaaactaaatattgaatattaaataattatttgatgtcatatttagcaagaatttttatataatattcatttctgttttattcaaaataattcttatactaattgcctctcgttgctaaaataaaaatgagatacaatttcttcttaatactctagaagacagaattatagttatccttacatacacactccacataatcccctgttctcagaacatctgaaagaccaatgataaaaatataaatgtatataaatattaaatagaacaaaaatatttgcatgcttaaaaactagatataactgggaaataatccctagtttggattttaatgctcagaacttgtcggatactttacaatgaagtgtcccaatttccactctaactcctaaagatttactaatttttaaaagttcagtctttgaaatttcacgaaattgaaatacgtcataagccttcctaatctcctaaggatattatcatcatattggtttatatatgtcagtagaacttattcgagtaacagctaagagaagcttacagctacttttaaaaatatctaaacacaggtttttctactaatactttgtgatgttacatgcagagaatattcaaatgaatatttaaaactatgatattagagacattagaaaataagatgcttctaaaataaatgtctaaaagttaaagtacatcaatttgcatatcaaaatatacataattttcagttagtggtctcttattttggaatctataaagaaagaccaaggtgggggggggggaggggggagagagagagagagagagagaggctcaataataatattaaatgatataacattttgaatgtcatctgaagtagggttataatgtaccataatagaagtctaattctgataagccatagattcagtggtttagaaaaagaagatgtttatgaatattaccaacatccacacagtaatccattttcacttttaaaaaatgatttttcatataactcaaaagtgttcctcaactgactgactttaggagtcaggtgagtcaatggatgaagacaaagagcttgatgctgatgacagaagtgtagttaagcttgaactctttttccatactataccttttcatccaaggccttgtggtgctcaaacaaagatttcagtgccttgagaacttcaacttcactggatactcctgagggagactgggcttgccgttttaccaccgtcattcttagtgatctttcatgtcgtgacacaaggcactccaaatgctccagtaatagctattgggtttaacagaaaatgcaattatcttatgaatacaagtcataaatacttacaaatgacttcccccttaaattattgcaggcttacatagtatctaatgttagctgcaggttacactgcaagcagcaacaaagaagcacagacctgtttaaaacagggtttataaaatacattaaagataaattgtatttgatcatttaacaagttactgaatttaaaaatgtaatgcaaatgtaatgcagtcctttagcaaatgtaataatttcagtacgaattcagcagaaatagaacacttggaaaaatatgtatgataatgatgaaagaacattgcttgatgcatcatgatctttttagaggatcatagtgacagtcaaaatttatttcatttacatatggccattaaaataatttgaattgaataaaatgagcataatcattaaaatgttactttaacttaatcacatggttttattcacaattagtctttagattaattatagaaaaatatatgcaaccaattagaacatagtaactgagattctcaattgtcagttcagaaaaggaagttaaggatacagttttaaattgcctgtgttagaatctatgatttcccagagtagcctctggggccatgacagaggtggagggaaagtccctgaagactttccaggctgtttcaggctttacactcttagcttttgccagaggagttctgctttgaaatgttttgtgaattggggtttcatatttgctttcatttcaaaaggaagttctactgctaaaaaacaaagatacatgagaagaaaatcagaaattgcttgattattttcagttattataattttactagtgaagaaccacacacagttggtgagcattataggaaaggtcttcggaagcatagtgaaaagcataggctaacaagtggtgtctacttatgcaaaataaagaagaaaataaagcagaaattacccaaacaaaagatttaaaaacagatataagacactgaaggtggaaagaataaagaaaacaactttatttttttcttttcaagatattttctaaaagtttaactgtaatgaaaaattttggttttcactataccactgttagattcattgtcaagtattagtatcatattttttggttgatttctctacatttgctgtcactaattatgactcaaaatgttagaaaactttgccattattgggcacaaagaacaccagtatctgagacactaaacatgcataaatcagtagataagagtcacatttaaggatcaaactaatcgccgggcacagtggctcactcctgtaatcccagcactttgggaggccaaggcaggcagatcacgaggtcaggagatcgagaccatcctggctaacacagtgaaaccccgtctctactaaaataataataataataatagtagtttttcagtatgaaaataacctgaaattttcaaggagccctttaaaatttatcaatctctgattatattatggtattctattctctcaaattctttagatacatgtattcattgcataaatccaagctgttttacataggttgtggagatttgcatgaacttaataatgtctgtttttccagtggcatctgatgtcaatctttcgctggcaaactatgttccagacttctgacctacttttagctcctcagtatgtcaagcctttgcttatgctgtaccctctgcccaaagcactccttctttggttcctcatttaaccagctctttctcattctttaagtctcagcttaaacatcatctctcaacaaggcatttgctcactactgtctaaagtaagtttctccttttccccacctccgcaagtctctatttcaatcccttactaattttcttcagaatattttatgatatgcaatttaaacaaatttttctaccaaatttcattctattttcccattgcaataaaagctccatgagagttggcacagtgtccgccttaatcctcttgatcctctctggatttgggtgttagctcaattcccaacatctataggtatgcaattaatatttgttgagtgaactgaaatgttaaatgagttaaatttacatacctcatatagttttatatatctcatacagatttggcctatatgaaagctaagcctgtggccatggttaattggcattatttcctaaaagcttaggctaattaacattattatgtacatctatccttcaatctgatgacaaaaataatgaaacctttacaacacaatgaaaactgtttttttttctaattgtaaattagagtcatcttgcataatatagtcgttcaataaacatatcagcatccaattttgcacaatacagtgtaagatttagaaatataaaatatccaccctctaggaaaagaaacacaataatgatgctataaaggatatctgttattagagactacctaaatcttttgatcacactcttcacatttggcaagtggaactttttaactgcttctccctaccctcatgtcctcattgtctctttacccagcttaaagttaacaattcagtatttgtaagcactctctttcatgctccctcagtttctagaatctgatcacttgccactacatccactgcttacatttgtgtccaagacctataatctccccctggattataatggctccttaactggtcctcctcctttcagcctttcatcttcaggctattctcaaaacactatttcagttaaaatgtgagttaggtcatttatacctctgctcaaatttttaatgtcttcttattgagctcaagtgaaagtcaaagtccttatacatcccaaagggatctaaattttctgaacttatctcctatttttcttcttgctcattctggtatagcttcattggctgccttgcagttttttgtttgtttagttttgttagttttgcttttaacaggctaaacatccatgtccccacaacaggggttttgtacttcttcttttctctaactaaaacattctctttcagaaatctgtatgactatctcacttcaccttcgctttcatattttaactcaaatgccacttttcaatgaggctttccctggttacctacaacattggatatctccttcctagcatattaaaatgttgctttgtgtcattaagtttttggatagtttgtcatatcatgataggtaatcagaaaaccttctcccaaaggatctgtaactatttattagagtcatagtactatggacaataaaatatcaaagtttcttgaatattacctctgagctaggagtaattttctgatcctcactctgtaagagtcttcagtaacctggtggacaaactgattcaccttgtagatatcagcctatttcccttgccaccatgtcgtatttctcaatgtgcataaagaagtgaccatggtttcagggttataaacctgacaaaatgggcttcccacgattaagactgatggagacaccaccatggctgaacggcccagtggcaagctgcagcaatctaacttgagccctgtcatgataaagtacagctggagaccagctattcaccatgaagcaagcatattatatcaaatactttttattaaagaggaggcagtttttcctcactataataaaccccctttttggatatagatttgctttctctaatgaccatacttctaccagaaacaccatcttaccgagtttttgcttacagtcatgttatgatatacaacattacttcagacaaaaaaaaaaaaacaaaaaaaaatctgattttacagtgaaaagagtaatgcaattgatgggtgctcccagggaccccggattttatcacaccattacatcatttagaagtagctgaacttatagaatggttaaataagccaagacttttttttattttttattattatactgtaagttctagggtacatgtgcacaacgtgcaggtttattacatatgtatacatgtgccatgttggtgtgctgcacccattaactcgtcatttacattaggtatatctcctaatgctatccctcccccctccccccgaccccatgacaggccctggtgtgtgatgttccccttcctgtgtccaaatgttctcattgttcaattcccacctatgagtgaaaacatgcggtgtttggttttttgtccttgcaatagtttgctgagaatgatggtttccagcttcatccatgtccctacaaaggacatggactcatccttttttatggctgcatagtattccatggtttatatgtgccacattttctcaatccagtctatcattgatggacatttgggttagttccaagtctttggtattgtgaatagtgctgcaataaacataagtgtgcatgtgtctttatagcatcatgatttataatcctttgggtatatacccagtaatgggatggctgggtcaaatggtatttctagttctagatccttgaggaattgccacactgtcttccacaacggttgaactagtttacagtcccaccaacagtgcaaaagtgttcctatttctccacatcctctccagcacctgttgtttcctcactttgtaatgattgccattctaactggtgtgagatggtatctcattgtggttttgatttgcattcctctgatggccagtgatggtgagcattttttcatgtgtctgttggctgcacaaatgtccttttgagaagtgtctgttcgtatccttcgcccactttttgatagggttgtttgttttttttcttgtaaatttgtttgagttctttgtagattctggatattagccctttgtcagatgagtaggttgcaaaaattttctcccattctgtagcttgcctgttcactctgatggtattttcttttgctgtgcagaagctctttagtttaattagatcccatttgtcaattttggcttttgttgccattgcttttggtgttttagacatgaagtcctatcatccctatgtcctgaatggtattgcctaggttttcttctagggtttttatggttttaggtctaacatttaagtctttaatccatcttgaattaatttttgtataaggtgtaaggaagggatccagtttcagctttctacatgtggctagccagttgacccagcacaattcaagcttggacataatacattgctaagtaggaattctatcatcctggaattagtatatcctcagaactactgatagaaataagatagagtttctttcttggaatagctatggatccatgtatgtaagtccagaaaccaaggtttataattggaattcataactgccaactaggacctgtgactagtggagaaaagaggatcattccttttttgttgacacacatacacacgctcacatacagacacacacactatatatacacacacgcatgcatgtttgtgtgtgaatatatatatataatgtacattaatacattattctcttttctgttttctgtaccctgttaccatcttttacccattaattatccccattttctacccctccccctgactgtttgatagttcctcacaatccaaatcccatcttcccagtaacatttcttgggaatgtttaccactaggtggcagacctgtgacttaagatcagtcaaccagacctgaccaccctgggagttagcctgacggggcagagaggaaccatgctgggaaggggtagtggcagaggctgcgtgtttctgggactgggcttgtgagaaaaatttacaaagctaagaaatgtggtcctagagactgtctgaaagctcagtttagagatttcttatatgctttaattaatgtctttatttaaacagccaagctatatactctgttttgtgcaattaggaactctcatctacatgataataaaaaccaaatatgtttttattaatataaacagactccttaagggatgaacgatttcacttatccccaataccaaggaaaatattctacataataagtacttaatacttgttgaattgggttaatgataaacatcaattattcagattgaagaatatggacaaaaatgttctcatctggcatatatatatggcctaatttaaggttaaaaataaaagtaaataaattaagagtacaaaaagtgatacttagctaagataccattaacaatctactaattacacaccttcactgggagctacaactttagcctaatatttaataattctcacagaaagtacaaatggaactctctttggtatactcaaaggattgtagagactatgtgaatggccatgaatcctatgtttgaattttctttaaatgaccacaggttctatgtgtatacacacatatgtatcatatattcacacacagacacacacacacacacccacacaaacccacacatcatgcgtcattgggaattttttggactaagttttgccttgaaaagcaagatggcccaggtaatctaaatcttttattttactatgattctgtaaggatttctaaaactatataacttcctattagatcttaattcaacaaaaccttgtgaatagttatttccaattataaatggcactgaaacagaaacacattcttccctgtagactaatgtggctgctgtaatatggtcatatagcatgacattaacatctgaaaacgaaaacctttaaattggttgccttcttactcaacccactccatatcttttaccctcaaatatcgtttaaaatcccatgtttcttatgctcatgtttgattatgaaattgaaatagctgttgggagggcgtatgtcctatcctatttactcttgtactgatcatatcctatcatagaactttcataaataactatatacgcacatgcatgtacacatatgtagaatctttatctgttttcagctgagaaggtcttccttttctgaattggaccgtattttctacccattgatgaaatacatttggatgacattattaactcgtacaggcagagatttgtcaataagaaaaaatttttctttagtagtgatgggtgtctaattgtatctcaatatctgttaagataattcctttggctcaaaacaaaagtgagggcatggtaagaaatgtgtcaaatgcaattatgtcttctttttaagtttatgatccatgagattaagttacagctttattatttataactaggtattaatactgtttcttgaaatcataacaatatgaatactgtttctcaaaaccataacgtttttctttttttttaatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtgagaattcaaagtcacacaatagttacattctaaaacattatgaacaatttaaaacatcctttgagatcttcagctataaaaatagttgaaacaactccgacaataaaaatgttcttcacgctgacattcacaggcaataactatacaaaaattcccagtttttctttacctcttcattagttcagataactttgtcaaaacatgtcttattgatcattttgagttgaaataacatcaggaataaattattttctataaatataaccttctgtaaatatatacttgccaaagtatggtcagaggagttttaggaataacaaattttgtttcaatattttttctacatttttatcagtataaaaatattgaacaaaaacttctttgtatgtttctataaatatccactataattttttgaaatttctatttttgtataattgtttataatattataatgattttattaggatattcttaatttaataacttgaggcagttggatttaagaacaactgcagtgatgactgattttctttcattcactcaaatttttgcaatgtcaacgaggtgtttctgtggagaaaacataatacatggccaggacatacatttcagctttgacctcagaataaaaacatagcagattgactttccacatgactaacacaaaataaagtaggattgaattacaaaaatttaaataggccaggagcagtggctcatgcctgtaatcccagcactttgggaggtgaagacgggccgactgcttgagcccaggagttcgagacaagtccaggcaacatggcaaaaccccatctctacaaaaaataacagaaattagctgggtatggtggcatgtggctatagtcccagctacttgggaggctgaggtgggaagatcacctgagtccagggaactctaggctgcagtgaaccatgattgtgccactgcactccagcctgagcaagagtgagacctcgtctcaaaagaattaaaaaaagaaaaaaataaatttgaacaaactgtattcttctttgaacataatacctttgcatcacatgtgaattgtgggtgacataggaatatgatttcttaaatacatagtctgtgggtaaactgagaaggaagtagtggactctctgggtgtttcatttataagccatttataggcctgggacaagttacttactaccttagttttctcttgaattaaatgggaataatgagattgctgtgagaataaagtgagttaaacatgtaaaacattcataaaaacatttagattttaatgttagctattatattatcattattactctctatcttcattcaattcccactggaacttctattttctattttggaagatggtataattcatccaaatatcattatacagaaggactttttctgatctattgtttttgataacattcaaaattaatacaaatgaccccatccacacatggtttcatggactggctttttatgttatttagctcagttcatgaacatatcctaactactcgatgtaaagtgagccacaagttgatcagaactttggaaattggaatgctcaattacactttatattttattttcttttatatatttatttatgtatttattttttgagatggagtctccctctgtcgcccagactggagtgcagtgacacgatctctgctcactgcaatctcaccctcctggattcaagcgattatcctatttcagcatcacgagcagctgaggttacaggcatgtgccaccatgcccagctatcacttgcgctttaaatttgctcacaatctgacaccaattaaagtttctttacatgtgagaaggaaacactagcttgttgctttgtctctatgaccagcacacagatatttatagcaagaagaaaagcacaacatctagaaagagaaacaactataaaatctataaaaatggttttatttagcaacatttgataaggcatctggtgtgaagagagacatatttgattttcagctctggatatactacttctgggggatggaggagggtgagaggtggttatgtaacttaaggagttattatataattaatactgtgtacaagggggttttcataaatctgttttccttgatgcagtcgacaacaaaaatcctccacatcactgctttaaagaaggtagaaatgtattttccagccttattcatattttcaaagtaactattatgcatggttgaaatcaatggcttcaatatctgttattgttattttaaaggaactttgtatttttctaattttgactcccaaataggtacttcacatgtggctcaccttcctccctttattatccaagactcctttgcaaacacaatagcctcgggtatttctggttctcatggggttcaatatgatgaaaattgtacggattctgtcaccaaatctcttagctctctaaaattcatcacaattagatactgtggtggtctgactgttaagcaatgtcctctctagctgtagtaagtctttgagtaataatgctgatggcctcatggttagtgcacaggctctggatttagactgccttacctttcaaattcattctttgctatttactaactgtgtgacttctggcaagttatctgaccttttctgagctcacttacctggtctgtaaaattgagataattataacatctccagaggggtgtagaaaggagtaaggggctgaagaaaaaaggctagatgaacctacacagctaataaaagagtgtctggtgcattttaaatgtgagcattagttataaacctaaccaaagctttgtatttccctgcattctcagctttctgctcctacttttacacttgagtgtgctgtgttaaatcaaggaatgtagtctaaagtactaaaatataacatagtggaatagggcagaataaatgtcatggtataaataaattttaaatttgcacgaaaacacagtgttaagttaaaaaagtcaagggtaggaaatatatagagaggaagacagcaaaagaaaaaaattgtctgatacctgataatatgatctaaactgcccttgttatgccctgtttgaggcaatccatttgacaggttcatcagagtatcattgaaaaccaattcaatgtatgcatgtatgtgaattctctttaccatgaaataagaccttgataaataaggacataaattcagtttgatcatgtaaccattatgcaagcaaccctatctctcattaaaggcacaagctcccagttagtagaactgtattttatattactctctaagactcataaagtgaataggccattagctatacctatttttttcaggattgatctattatagctataacatttaaactatttttcaccaacttcagttgtatttaaattgaacttacatccacatagaagtggtttttttctacttccttttagtaaactgtactcctctatgggtaatgtggtaatttacatgtttataaaatttagtgattttttttctcaaagaaaatatagcatgtttatcaaattctgaactttaatgttacatggcatgtcatatgcttgatgaaaatacatgggtttccaaaagtagaatctagcaaattccatgagtttcatgaaatcagaatatcatggctggacattcccttggaaatttattaaaacataaaggcactcctcttttaatgggcagatttttttttcagtttttttttcttgacactattttttgtttcctttttattttatttattattattatttttttgagacagagtctcactctgttgcccaggctggactgtggtggtgcaatctcggttcactgcagcctctgcctcccaggccctcccaagtagctgggactgcaggtgcgtgccaccaagcctggctgacttttgtatttatagtagaaatggggtttcaccatgttggccagggtgatcttgaactcctgaacttaggtgatccgcctgccttggcctcccaaagtgctgggattacaggcatgaggcatcgcgtccggcctttttttttttttcctttttaaaaaaatcttctgctgggaggaggtgagaaccaaacccaggccactcttttgtagcagcccttaatttaaactcttcctcttttccaaaactctcctcttttgcccatttccaacctctgagggattaccctacccccaaaacaaccttttgaaagtttgaaacccattattgaaatccagatcttctttttaaagccaaataaagtaaaggccagaaggaatgtgaacattttgtaaagcaacatagtgatttagtagctgtgactataatttaggtttcctgtctttttgttttgagttttatagtatatcctcctttactttaagtaactgagttactatctgcttaaagtaattataaagttttaaaatgcatatattttcttcttatatgtgtgttacatgtaatgcattgaactacaaatagaattaattccaaaaaggctgctttacacttactcttgtgttgtttctttcagctttaagttcagagatttcttcttccttttctagaagttgttccctgcaggcatttaattcttttgtcagtgcagcaaattcctggaaaagtaataaaaatatttgaagaaatattcaagatctaaaagcagaaaaaaattcaaaatataaatttcaaaatgaaaagaatggggaaaaatgaccccactgactggtcaacatatgttgctgttatgaagtatcttaaatacattattcaaaacatgctaatccataatatgtgtcatatgcattttattacagtacactgcttagatgggtgtataaagtatatttcaaaatatatcagatacatcacactgagcctaacgttaatatgataacttattcctagagtaaatttaagtttggctaattttatgaacagctcccaaaatcttacactttaattcctatacagcaatgtttatacagagtacagtggatcttcagaacaaccgcaaaaaaccctgctaaacatgctattttgaaattaacaaatttatttgttaacaagatgaagcagaggaatctacctttttttttttttacaaaataacaaaataacaaatatgcctaagatttgatagcattatctaagattttcttattaatttgcgtattgctcagtctttctaaaaggtaagctccatgtggacaggggctttgacttgttcacggttacaccaccagtgtctaagacatagtgggagctcaaatggtatttatttttagttgatagaaataggtcatattgttacaaaaaaattggggattctggagtaattctgtcttcatgtggttaatgacactgtgaaggaatcttcattggcctccttcccctaaatgggatcagagatcatatgatatggtatttttaccaataggtagagagtttgttaacacacagaaaaggttatttaataagaagaccaaaaaatgcaactattctgctattctaccttataaacaaatatttatttttttaaatatagtaaatagatccatattatcaccaaaccctttagagtgattttcagtagtaacactgatgcttatcaaatatttaagtatttgggaaaacttaggtccatgctgagaagtcactcagaagattaaaaaacataaaatgaaggagacaggtttggttaacctaacctccagggaggcaaatttaataaaaagtaaatgaatatgatgattatgcaaagctggggaaggtttggagtttatatttttgtttgcttcaaatcatttattttgcttagtttctctaaagggcttcagcccaagtgagtacttcaaagatctcagagtaggcttcagggcttagattctagatgacagagtttgttgttgctttttggctgacatagggataaatgttttcttccctgattgccgcctgcttaaatgttgctaatactctgagcatattatttaggtggtaaatggaaataaagcaaatagaaaacaataaacctttctctagaaaataaaattttcttcatatacagcatagttttgatagagaaaagaagtgatacctaaagattctttattgcacattattaacatgtaggcattcagaaaaaatcttatacttatgtatattataaacattgactaagataaaacataacatctgtatatttatcatactaattataaaaaatttattcatctattagaattttaacattagatatctctaggcagtgaaattatgaatgaattttggtttttggcttccacccaagtatttctatcatcaaactttttacaatggagaaatatgttttcgtgctttgaaaataagagaaaatataaacctgtaagtgcactgaaacaatcaagtttttaaagcagaggggagaaattagtgaagatgttataggccacagaaagctcggccttttttattatcatggcactgattctgagtaggctagtgactccatgtattaagattagtcttacatttactaacttcctagcaactttcaggcactactttcacatttattataccaccttgctctctaaatacctagtgaggaggtctcactcccatcttatggctgaggatactgaataatggtaagctgtatgtctaagttcacaaaactcacaagccatagggagtgagttagctctgagcatcattctccactgcaagtttagtgcttttctactatttcactttgaacctagttgtttgttgggtttatattattcagatctggagtacatttagaggtaccctttttccttatctgaaacattaaataatattactactgatatggtttggctctctgtccccacccaaatctcacattgaattgtaacaatccccacgtgtcaagggcaggaacaggtggagataattgaatcatgggagcagtttcccttcatattgctttcctgattgtgagtaagtttgagatctgatgattttataaagggaaaccgctttcatttggtcctcattctctcttgctgccatcatgtaagaagtgccttttaccttccaccatgattgtgtggcctccccagtaacgtggagctgtgagtccattaaacctctttttctttataaattacccagtctcgggtatgtctttatcagcaacgtgaaaaagaactaacacaactacaattatcttgcatgatcccccttaattagtccaagagtgtggggaactagaaggtccaaagtatagtataccttccacacagagcaacaagtgttagacaagtttgttctatgtatctgagactgtgtagaggcagatatctcacatggagttaaccaccaaacattttaacacttttcctctgacagttctctttcctatacctattctccttactgtgaacatgaactgaggcttacatcatcttacaaagataccactaacagcaaatagggttaacattgattgcaaacttacagtatgttaggtcctctgccaagcaatttatattaattacctcatctatcctaataacacaccttaagaaactactaaaatctcactgaggcctagagaagttaagtacattgtgcaaagttacacacctagtccatgatggagctgggctttgaacccagacaatctaactcatactgggtgattacgataagttgtttgtttcccctgaccacattttcccttctgatttgtgtttcaatttttggaaaaattatatttcccaaggtcatcaaactttcagtgctttttaccttcaaatatatcaaatttaaaccaactttaactttcaaaattcaaaccacccaaaacataaccctttcataactaattagctttattacttacagaacaatagcaactattaataccactttgagcagttggcactttgttttgccatgccccaagctaaccattttacatgaataactccatcgactccctatttttcagatgaggacactgaagcttagcagtgatgaataacttgttcaaggtcaccgctcaatatgacccactttgattctaaaacgtttagatttctgcaacactgcctccttctggctaaaaatggagtctctttatcaaatgtctcaagcattctgggattatcatccgtctaactatccagccattcatacaacatttgttgaccacttaccacatatcagaccctgtgctagatgctgaagatatgaagataacatagaacagttgttgcagttgacctcatagaaatgtcagaattcacatttgaggcccatcagggatctccatcattaaccagcactcaaaacccatcaccaaagtgccacacagagtaataccagtgtatgccctttagaagtcatatgtccctcaaaagcctccttcttagatggtctatcttctgcaactactgtgaaacatttctctttcctgtttccatttctaccttttcatttttttcaactttttttcttgtttctttcacaaactacctactgtgcctcaaatactcttcatcatccctctgcctaactaattcatttttaaaagcactagttagccttcttaatgctttaaaatacctagttgtattgtttttataactgaattatgtgttcgtctcctccacctaaacagtacaatcctttaaggcaaggttgttagagtatttttatatccttaggtcttagcatagttcctggaaaattaagtaaacagtaaatccttgttgtgataataaataaatggcttactttcctcaaactttggactttgataccaaaataaatttagaagatattattggaggttttttttaaatttttctaagtgagatcactataatttgcttaacatataacagatataatattcttttttactttgtagctgttgttttgtctatattgaaatatgctatattctacacggcaatgacattattgtctgccatgcttttctaacatatatatatatatatatatatgttagaaaacatatatatatatatatgttttctaaaagacccatacatatatatgtcattttgctctttgtagttgtgactgatctaattctcttatctcactgattcaaacacacttctacagattccttttaattcagacatggtgaagtatgaataaagtttccttctaagatttctcactgctttaaccttctgataatactctgtattatatattgtattctgtttcttacctttttcactcatatatatgtatgtatgtatgtatatgtgtgtgtgtatatatatgtgtatatatatatatacatatatatatatatatatatataatatagcgattacctggaaactgccaaattcaacaaattattcagaaaatcttctctgatcctggtagtttcttcaaagagatctgcagtatacctcccacctaggaataggctagctctagtgctgaagctcactattatgaaagcataattttgtgatataaatatttgtgttgaatgcaaagatactagaatgaatgagagcatatgcacctgagagaaaatgaatgtggcaggagaaataatgaaaatattttctattccgtagtgctttgggcctattgctctgaataattcatgcatttaaatttatcatttgttcattggatctatcacattggtcttattcatgcttaaagtgaaagtatgtgtttaactaatatggtatttctctagtctagcatttctcaaattatgattttagaacagtatttccacaagattcccagaaaggaattcactgggaacaacctagacttccatatatataaaaatgtatgatttaaatatagtaaatgtgcatgatggaatattatgcaaagggaagaataaacaggttagatctttgtacagcaacatggaaagatttcaaaaatataattttgagtgaaaaaggtaagaaacagaatacaatgtataacacagagtattatcagaagcttaaagtagtgagaaatcaatgttagaaggaaactttattcatacttcatcaagtctgaattaaaaggaatctgtagaaagagctaagtgtgttaaaatcagtgagataagagaattaggtcagtcgccaactactaagcatactcaacaacttttcagactattttgttcaccaacctatgcatggcaaatactttctttttccaaagagcaaagtgactttccccactctatattttgtcctttggaattttaaagaacagtcaagatctagaccacacagtgccacaacagtaccctcagcacgaagggaggggtgcccttctctttcttagtgtgtcctcaggcacatcacaaacacatttatatgagcactcactatgtagtggaccctgtttttagtgctgggaagatgacaagcaaagaagcaagttaaagtccctgctcttgatatgtttacatgcattcagggaattaatcattcaaactacttttctctgaaattaatcttttctagccatttctatccctctcaatagtaattcagctcatggtgtaaagcaatagtttctttatttaaaaaaagaggaaaataaaataactttcttttctgttaatatcttaaaattttgaaagtatcatttcttatacaccaacataggacatctaacttctgtgcactcctgaatttgttacaagtctcttaaattacataaaatctaaagctcttctatttcagctaatattcccagttgttacctttttacttattttcttccccgctcccatcatttttttcttttaaaaacagggtctcacctgtctttaaaaaaggacaggggtcttgctatgttgtccagcttatctcaaactcctggcctcaagcaattctcccacctccacatcagctttccaaaacactgggattacaggtgtaagccactgagccttgctgtttacttaactatcatttcttaagtactaagtatatgctgggtacattgttatgaactttacctctattatgtcgtttaatcattatagcagtgttattattcacagaacacagatgagaaaagtagaagagattgtttccatcaaaacccattctattgtatggcaatgctggtgccaacatccctgaaacctgtcatatcccagagcaaagataagctgtcttgtatcttatcagtggtttcactcttttgtgctgacttctaagctaaggatgagcttgagtaattcaagtgtctgtgctgcaaatatctcaaatgacaggccttaggtcaatatgttgttcttagtgagtttaatgaaaagaggcttctcttgttttgatctctgcatatgttatttccaaagtgaaaaatacaggggcaaagcatagattcactcagttcttgtgcctatttacattcctagacaggaaattaaagagtgtataacctcttctggtcaactttcctcttgtttttaacgtatgccttttccacctggtatatcaccatagcctatcgggctacccattctcagacagacacagagcattctatttttatacaggttcatctttaaactcattttctgatatttagtaataaacataatagagctggaaaaaaaaaaaaaacttctaacttccctgactcatttcagatggtatgcttacttgaggaggtttaattgagaaaaaaaatgacatattttctcatttactaaatgcttgaaaggctttgatttaataggtaagtccccacctcaggaaagctggttaggagaagctgcatggtaagaggaaaattcagcctttcaatttcaagtcaatgacaccagacagtctccagagaaatctctgacaatgcattcatcttgattacaattttaatactctttacctttcaattaaacctgcattttctaatcttgtgggccacttaattaatgaactgacaatggccttatttctgcagccatctatctgagtaagtcctgccttgaagaatcgtgagtgcaaaccagtttgagagagaagaggaaaaataaatggtgagttggaattcagcttcactaaacactgccaacaccctcaccgaccacaaaaaagcatcttttaagtttattcttcaaccatttgtgcaaatcaaaaatagcgctcaggaaagcatatggcatggaagcatgctgatttgaccatctagcatttcaattagacaaaattaactgcttcaaaatgctttttttataatgacttccttagtctaggcccctcatttactgtagtttggtgtttcctcctttgaactttaataattcttctagcaattctatttgtaatactcagtggaaagctttggattttaaatctatttttatttgcatataatttcacataaatttacatgtaaaaaaatatgtatgtttttccccaaaccacaggacatactttctagaaccgattaataacagaagtattacatttgagagatataaacaaagcaacaaaaagataatatatttctcaaattttatatctacacttagtatatttgctggtaaaaattcagaggagtctttagaaattcagtttggaaatcatttagtttgggaagaaaggcatatagaaattaatacgtaatcattatatcactatgtatatgcaatatttttattttattatgtaatcaaatgcagtgttaatgacctctgtttttataattgccttctggtctcacatgagcccagggaatgctgtcatccaaaattactgtgcaaaacagtaatgtctcacggtcagccctgggctagacagcttgaaggtagaatcgcctgcataactaatgtaatgtgacaggcacaactggactcagaattttcacaaaaatcattgggtaagatggctcaagttaaaagaaaactgggtttaaattccatgtgcattatattttgtgcccccttgaatttttatgtatctatattctaattagaaagctttttggtctttttcctaaaactgcataatagaagactatgttaacatatcatggtgacttgggggatgcaagcctatttaaaatccaacatgctacaaaagtcattcccttggtagatgtgtacttggatacttagtaacttttgttttcaaaatcttctaatcaaggtacttagaatctttcaaaaagtggatgtttgtggaaatcaaaattgtcaagcagtctcaggctgtctgtccatcaagccatgaatcattcactatgctcctactgaaacgtacctatcttatatcttattcccactctgctttgctttgtggacaccaatttctcaatgtatatagagagctgccccaggtattaggctttctttgacaatagcttgctagagatgagtcagcttgtttttaaaccctggagagccggtactacagattgtttttaaatcctggagaggtcactacagattggttgggaacgtatttggaggcaaggtagggttttctcagtatccccacaatggctgttctgctgcactgcattgcttctgtgggccctagtcacatttgtcttcttgggcccattcatctattaaaaaatatatataatttttaatatatataatatattatattaaatataatatataataaataatattaaatgtaataaataatatacataaatatatatatattaaaaaccatgcagtttttttctttaatggtaactgaaacgtaactcgagattcacctacccaaggctcattttactcattgccctttttctttggaaggcactaatactgaaactaattttatatcagggacaagaggattatcttcaagcataataataaaaaagagagagttctactatatcattagcaaactagcatggcagaagtgattgacattagtgtgatacagtaaaaatactcagcacatttttggagagaatatatcttactgtacccctctgttcctgtgttcctgcagtaattcttgctgatcaaaaatttacattacgactacctaagacacatcaagtgacattctataatgttaatgtatataagggtagagcctatgaggaaattctctagatatcataaaacagttcttaaaagctttcttaaacatgtctctggccaggcgtggtggctcacgcttgtaatcccagcactgtgggaggccaaggcgagcggattacctgagctcaggagttcgagaacagcctgggcaacacagtgaaaccctgtctccaataaaatacaaaaaaattaaaaatatccctcagtatctatggaattagaacatgttacattatttgaacatttgatgacaccatgtcatgtcagtgtgtcctttatcttctattatcgtctcctcatctctctgattgcatctattatcactaacccagggctcacacacctctcaagatgttttctggtgtctgaaatgcaatgatagtataaaacatatttgagaactttttaatgaacccttgcattgcttgttctgagatgctgttttgagaggagcccagctgcctacaagtctgaccagaatccagggttaaagcctgaagtctttcacagattccctgacccaggtgggaaggatgctccctattgaatgaagctcccacctcaccctttgggctcctgctctaagtttgagtggctgccttgttcccatatcctgtccctctgcataatattactagaatgagaaggagacaaacccaacggcttagaaccaagactgaagttactcactccaagtttccttttcctttgacttgctccatctccccttcatttttctccaatagaaaaaaataaaacaaaaccttgttctggtcttattgtatgaaagaagagagagggaggtcatcaggaagcaattctaacagaggaaccaacctacttcttcagccaattaatgctcttgtccttaattctgactcatctttatggaggagagggaaagaatcttcaatctctataaatgcccaaaagatatatttgcttatttgatgcttcatgcatttgtacatttattaaaactcgacattctaagtacattagtacaatcaccaggcccagtaagcattgtagttaaagcatgtcagggctgagtcattgccaaccaaaaactcttttggcaggaaaagccaattttcaacagctctgacagtgtaaagcaggaggcatgtttgacaagatgctgcatattaatttaaaagactttagcatctggttaggtaacacctgctgtggcaaacactcccagacacacaaaatagcattcgagctgaatatttaaatctcccaacatagctcaacaaagctctaactctaaacaaaacaaaacaaaacaaaatcacatctctagcaatcagttataattatataaccaaaaatatttgggctacaacattgtttgctgttcactgagctgaaatgctgtagtgggtgctataaaagttgtaaaatctattgaaacatattttcctgccttgaagaatttaactgtgtacaacatttaaaattgcacactgtagctcagaaaatagcactttgtgttataatatgttatatcaatatacagctaagaagtttatcactggggggtggggggtgaaagcattaaataacagagtaaaagaagcaaaccatgagagagaaatctggaaagactcttctagccactctctctgtgaaagtacatcccagcctaagaattgtagttgtctggcaatagaggcgtatgagagttctggaattgttaggacacactaacatgacacggtgtcatcaaatgttcaaataatgtaacatgctctaattccatagatactgagggatattttttaattactcaattttttatgtcatttactgtagagaaggagcttgcccttgtcagcctagtttggatactggctcacttgacaatgcatttctctctgcaaattttaaaaactgacactttgattatttctctatttactcgacaaaattttattggatgcctaatatgtaggagagcctgtgaaatttttcagacaatacaatgtgtacaatggtgaaaaagacatcgtaaatagaagtaagtgaacaataattacaatgaaatgtgataaacgctgtgatggggttatatccagggtgccccgcatgcacccctgtaggagggtatgtgcgtgaagggggcatctaagatgaaatgtgaaaaatgagtaagagccaggcaaaatgtatgttgaatgaaaattcttccagataaagggagcatcatgagcaactttctaagatccaaaagagcctaagcatactaaacctataaaattcttacagaaatacatagaggtaaatctttgcaatcttggattaggtaatggtttcttaaatgtgacgccaaaagctcatacaacacaagttaaaatagtccagactccatatgctatgactgaattgtgtcaccaaatgcatatgttgaagccctaatccccaacatggtggtatgtggagatgggaacgttgggaaatcattaggtttagatgaagtcatgagtgtagtgctctccagctgggattatttcccattttagaagaggaagggacaccagagctctctctctgctatgtgagggcacagcgagaaggcagccatctgcaagccagaacgaggtctcagcagaacccatccatgctgaaactctgatctcaggtttccagcctccagaactgcgaggaaatatatctttgttgattaagccatccagtctatggtattttgttatggaagccagagttaattaatataccataaagttaagatgtttacacttcgagtagtatcattaagaaagtgaaagacaatccacagaatgagacaaaatatgagcaaactatatatctgataaagggctggttgtcaaaatatataaataactattacaattctataataagaagacaaataaccaaatttatacatgaacagataatctgaatacacagctctctaaagataagtagccaaaaagcacatggaaagctgttccacatcattaatcgtcagagaaatgaaagtcaaaagcacagtgaaatacaatttcacataacctagaatggctataatcaaaaacacaaataagcattggcaaagatgcagaggagcctcatacactgctggtgggagtgtaatatggtgcagccactttgcaaaacagtttgtcagtttctcaagcggtaaaacatagagttatcgtatggtctagcaatttctctactaggtatatacccaagaaaattgaaaacatatgtccacacagaatcttgtacatgaatgttcatagcagtgttattcattatatctaaaaggtggaaacaatccaaatgttcaacagtggaggaatgaatttttaaaatgcatatacttttttgttgttttatttcatatcgttttattttctgtgataagaacatttaacatgatatctgacctcttaacagatttctaagtacacaatacctaaattgtaaaccaaaggcactatgttgatcagtacatgtctggaacaaactcatcttgcacaattgtaattttatacccattgaacaacagctacccacataccccttcccccatctgctggtaaccaatgttctgttgtctacttctatttctgtaactattttagatgccacatatgtgaggaatcatgcagtagttgtccttctgtaactgacttatttccctcagcacaatgtcttccaggtcctttcatgttgtcacaaatggtaggatttcattcttcatttttttgtctttcctttatttatttatttatttatttatttatttatttatttatttatttgagacagagtcgtgctctgtcttccaggctggaatgcagtggtatgatcacaactcacaacttactgcatcctctacctcctgagctcaaggggaatccttccacttcagcctccaaggtggctgggaccatagatacactccactactcaaaggtagttttatttttatttatttatttatttattttggtaaaaaagagatctccctatatttcccaggctggtctcgaactcctgggctcaagggatcctgctgcttcagcctcccaaagtgctgagatttcagccatgagccacagtgcctggcttgggtttcctttttttttttttcaagggtgaataattttctattgtttgaatatatcacactttctttatccattcatctattgatggacatttaggttgttttaatttcttggttattctgaaaaatgttacaaaggacctaggggtgcagatgtttcttcaagattctgattttaatatctttggttatatacccagaagtgggattgctggatcatatgctcatcttatttttaatttttttgtgaaacctccatactattttccatagtggctgtaccctattacatttccaccaacagtgaatatgggtttcaatttctccacaaccttgccagcatttgttttcttttgcttttcatttttgaaaatagccattctaacaggtactaggtgacataaggaaatttttgaggtgatgaacatgtttattacctgaattccattgtggtgattgtaacatgagtatatacatatgtccaacctcacaaaattgtatacattaattatatgaagagtttttttaaacaaatacacacaaggaaatattattcaacaataaaaagaaatgtagtatacatgctataatatggatgctccttgaaaaatatgctaagttaaagaagccagtcacaaaggaccatattgttgtatgatcctcttaatatttaatgtccagaataggcaaatatacagaaacagaaaatgaattagtggttacctagggctaggggagttggagagattggaggaggtgagagctaaggagctctggatttccttctggggtaacaaaaatattccaaaattaattgtgatgaggatgcacaattttgcgaatatactaaatgccaatgaattgcatttttaatggctgaataaaatggtatgtgttgttgcaataaagctgtttaaataacagtagttcagtttggatggaatggagggtaagctatgttagttattttggtctttggtaaaaggcaataatgggcaccatggaaggaatttaggcaggtgaatgacattattaactttatcttccttattattagtttagcaaccactcaaggaaatttaaaacactaaatttctggacttgccagactaagggccagactctggacctcaccaaattcatcaaggtaatgtaaccctgaaatattctttttagtaaccagtatgcttgtggacacttaattcttttaacatcaatagcatttattgattgttgccattggacccatccttatgaccatcttaacatctccttccccagcaaaaaaacaaaacaaaacagaacaaaaaaaactaaaaacaaataatgcttcacattaaaaatatgccattttctctcctgttcctaggggacttcccttgctatgagtatcttgctggtcagtagaagcagaaagaatctcagatgactctgctttcttgggaagcactttgtaaaatacaattttcaaaaagaaaaaatatataaaattactcacatattatcttaatctttgcaattattcataagcagtttgcaaagactcatagtaggaataactcttgaattctctctatcctgtagctatttactcatttatggaacaagccttgtaagtattgaattgctacagaaacatatatgtacataaaactgcatgtagggccgggtgcggtgactcacgcctgtaatcccagcactctggggggctgaggtgcgtggatcacctgctgtcaagagttccagaccagcctggccaacatggtgaaaccttgtctctaccaaaaatacaaaaattagctgggcatgatgtgggggcgcctgtaatctcagctactagggaggctgaggcacaagaatggcttgaacccgggaggcggaggttgcagtgagccgagattgagccattgcactctagtctgggcaacagagtgagactccacctcaaacaaacaaacaaaaaaattccatattggtagcaaaatatataactgggtatataacaaattgaatttttgctattttataccatcttcctacagcttcatcagataaaccacatgtgtgataacactctgtactccttcgcctgagacatgaaattatcatgacatttttcctgaagcagccgcataatattccttgatgctggactttaggcagcaactacttaataacccaaactggcacccaagatgaattttattggccatgctgttctggaattgtaaattttttacatctccttcaaaatataaagtatagatcatagtccaagttagaaaaatatcctaccaaaaattgtccaactgcagaaccatgactttgcttattatttacttatatcaataaattacattagaatgattgactgttgtccatgttatgcacagaaatcaacataagataatcaccttatttgactgcagggccatagcattccttactcatttttatttatgtaataaataatgttacctgggaaaatggaaaaacggctatgtgtcaaagtgtgtattcagatgttctttcttctcacatttttctttaacaatatatttcaagagaaagactatatttcaagtaagaactccaatctttttttaataggaaaaaatgtttaacaccaaggtaggaaaatattctcaacatttccttcgtgtagaattgtattctttatttttaaattttaattaactaatttgttttgagatacagtctcaccacttcgtcaagcaggctggagagcagtggtgctctctcggctcactgcaacctccacctcccggtttcaagcaattcttgtgcctcagcctccccagtagctggaattacaggcatctaccgccaagcacagctaatttttgtatttttagtagagacggggtcttgccatgttttttgggctgctctcaaactcctggcctcaagtgatccactggcctcagcctcccaaactgctgggattacaggcatgcaccaccacacccagctaatttttgtatttttagtagagatgaggtttcaccatgctggctccactggtcttgaacccctgacctcaagtgatccgcctgtgccagcctcccaaagtgctgagattacaggcatgagctattgagcctggccctcttgtggagtttaaaatttttcttttaaacaatcccaaatttgtaaatacatactagcaccagtatcattttgttataacttaactgctgtgaaatataattattactttttgactgtattctttaaaaatcctgtaatacacttcataagcaaaaattgttattatttctaaatgtttttccatgaattaaagaaggtttagccttcttctaatgaactataagtttgctaattttgccctattgttttgtatagatcactcttagaatcatttaggtgataaagtcactagcagatacaaaagagggactctgactgactgaaaaatctagatagatgttgaaaatgtgaattatttataatagaataatacacaacacaaaaataaaatggtattttaagattaatgagatttctaggtgaattatttccaattttaattattcatactactctttctttgatttttgttagtaatcttggatagtcaatcttcagatcccactaagacagaacactagaagctttaattctattctgtcatacaaacctctgtatctagatgataaactctgtgagaaccagaactaaaactttctggccttcgttattttgccagctccttacatagggcctgaaatagagactgtgtatttgttaaaggaccatggtaaaaggatcacatttagtaactaaagtttgatgcagattagtaagcatttttatttaagtaaaaataagaacaaaaaatttgttcctgataaacctattggtgaatgaatcttaaaacatggcatatatgtttcattattttaaaactgttattctgtaaacattttaaacttattttatataatgtgttttataattttaaaattcgagaatacaatttgctatttattatttctcctgattctagcacaaggaaacatagttcttcccgtgattttaaatattgacttgcaagctcatatttggttattttaatccgttgagatttcttctgtaatgtccacctgaaggcacttcagagagaatatatattttccttctgctaggcactatgaatcaaggactactttaagttgaaagggttaaaaatgtgaacgctgatctttttgttattgttgttgttttgagacgagtctccttctgtcgcccaggctggagtgtagtggcgcgatctcggctcactgcaagctccgcctcctgagttcatgccattctccttctcagcctccagagtagctgggactacaggtgcccgccaccaaggccggctaattctttgtatttttagtagagacggggtttcaccttgttagccaggatggtctcaatcacctgaccttgtgacgatcatttttaaggacagcaatgtggtaactttttattgtccctccaccttagctcaagcttatattaatggtcaaactgatgtctttttgttgatgataagtttcttctaggctagtctatgtctttcagagtgaagctcctcagaggctctggacttatgctgaagttttagtttgacctcctttcattcctcaagtttctagttcctggaatcagcaaatatctacagggtgctccagctttcagaatacactctgctggtttttaatgatttggtttttcatgaaagtgatgttgagagtttaaaagcatttgtgttgcatttagtctaggtttttgtagtgagaagtctttcagactttcctatttgccacacagtctaaagcagaagttgaatatgatgaaatatttatagatgttaagctccaatactgaatattaaaagcaattcaagccattgcagaatcatccctgaaaatttgtatttattttctctctgccagttacctagtttgtgagacacatgattaaatgtgacataaaaattaagttcataaagaaaaatacaataaatctatatttatatcacataaatatgaactgtaaaataattcagtcaactaaaacagattcacatttcaatagtgaaagtgctctctgttaagaagtttggtctgcattgtggaagacagtgtggcaattcctcaaagacctagaaccagaaataccatttgacccagcaatccaattactgggtatatacccaaaggaatataaaccattctattttaaagatacatgcacacaagtgttcattgcagcagtattcacaacagcaaagacatggaaccaactcaatgcctatcaatgatagactggataaagaaaatgtggtgcataaacaccatggaatagtatgcatccataaaaaggaacgagatcatgtcctttgcagggacatggatgaagctggaagccattatccacagcaagctaacccaggaacagaaaaccaaacactacatgttctcactgatatgtgggagctgaacaatgagaacacatggacacagggaggggaacacacactggagcctgtctgggtggtagcgggggaagggagagcatcaggaaaaatagctaatgtatgctgtgcttaatacttaggtgatgggttgatgggggcagctaaccaccacagcacacatttacctatgtaacaaacgtgcacatactgtacatgtaccctggaacttaaaataaaatttaaaaaaagaaaaaaaaggaaatttagtctgaagaagaaagacaaaacctcaggattgagagaaaaggaggagagagagctactttcaattatttgaaaaggctttcacctggaaagcctttgacaaagttcctttgacagagaatgattatgaagaagtcaggaaaacatatttttacaaaatgatatattccaccatttgttcattgaatattttgaaagtgatggccatgtgtgaaaatctgtgctggtcttgtgccggtcttcaaagggaatgcttccagcttttgcccattctgtatgatattggctgtgggtttgtcataaatcgcttgtattattttgagatccattccatcagtacttagtttattgagagtttttagtatgaaggaatgttgaattttatcgaaggccttttctgcttctattgagataatcatgtagtttttgtcattggttctgtttatgtgatgaattacatttattgatttgcatatgttgaaccagccttgcatcctaggggtgaagccgacttgatcgtggtggataagctttttgatatgctgctagattcagtttgccagtattttattgaggattttcgcattgatgttcatcaggaatattggcctgaaattttttttttttttaattgttggatctctgccaggttttggtatcaggatgatgctggcctcataaaatgagttagggaggagtccctctttttctattgtttggaatagtttcagaagggatggtaccagctcctctttgtacctctggtggaattcggctgtgaatccatcttgtcctgggctttttttggttggtaggctattaattactgcctcaatttcagatcttgttatatgtctattcagggattcgacttcttcttaggttagtcttcggagggtgtatatgtccaggaatttacccatttcttctagattttctagtttatttgcatagagatgtttatagtattctctgacggtagtttgtatttctgtgggatcagtactgatatctcctttatcattttttttattgtgtctatttgattcttctctcttttcttctttattagtctggctagcagtctatctattttgttaatcttttcaaaaaaccacattctggattcattgatttttttgaaggattttacgtctctatcccttcagatctgctctgatcttagttatttcttgtcttctgctaggttttgaatttgtttgatcctgcttctctggttcttttaattgtgattttaggttgttcattttagattttagatctttcctgctttctcctgtggacatttaatgctataaatttccctctaaacactgctttagctgtgtcccagatattctgctacattgtgtctttgttcttattggtttcaaagaacttatttatttctgccttaatttcattatttacctagtagtcattcaggagcaggttatccagtttccatgtagttgtgtggttttaagtcagtttcttaatcctgagttctaatttaattgcactgtggtctgagagacggtttgttatgatttcctttcttttgcattatctgaggagtgttttacttccaattatgtggtcaattttagaataagtgcgatgtggtgctgagaagaatgtatattctgttgattcggagtggagagttctgtggatgtctattgagtccacttggtccagagctgaattcgagtcctgaatatccttattaattttctgtctcattgagctatttaatattgacagtggggtgttaaggtctcccactattactgtgtgggagtctaagtctctttctaggtctctaagaacttgctgtataaatctgggtgctcctgtattgggtccatatatatttaggatagttagctctacttgttgcattgatccctttaccagtatgtaatggccttctttgtcttttttgatctttgttggtttaaagtctgttttatcagagaccaggattgcaacccctgcttttttgtttgtttgtttgtttccacttgcttggtaaatattcctccgtccctttattttcagcctatgtgtgtatttgcatgtgagatggttctcctgaatacagcacaccgataggtcttgactctttatccaatttgccagtctgtatcttttaactggggcatttagcctttacatttaaggttaatattttcacgtgtgaatttaatcttgtcattatgatgctagctggttattttgcccattagttgatgcagtttcttcatagagtcgatggtctttacaatttggtatgtttttgcagtggctgatactggtttttcctttccatatttagtgcttccttcaggagcgcttgtaaggcaggcctggtggtgacaaaatctctcagcatttgcttgtctgtaaaggattttatttttcctttgcttatgaagcttagtttgactgaatatgaaatctgggttgaaaattcttttctttaagaatgttgaatattggcctccactcttctgcagagagatccgtggttagtctgatggacttccctttgtgggtaacccgacatttttctctggctgcccttaacattttttctttcatttcaaccttggtgaatctgatgattatgtgtcttggggttgctcttctcgaggagtctctttgtgttgttctctgcatttcctgaatttgaatgtttggcctgtcttgctaggttggggaagttctcctggatagtatcctgacgagtattttccaacttagttccattctccccatcactttcaggtacaccaatcaaacgtaggtttggtcttttcacatagtcccatatttcttggaggctttgtttgttgcttttctttctttttttctctaatcttgtcttcacactttatttcattaagttaatcttcaatctctgatgtcctttcttccacttgatcgatttcactattgatacttgtgtatgcttcatgaagtactcgtgttgtgttttttagctccatcaggtcatttatgttcttctctaaactggtcgttttagttagcaattcctctaaccttttttcaaggttcttagcttccttgtatggggttggaacatgatgctttatctcagaggagtttgttattacccaccttctgaagcctacttctgtcaattcatcaaactcattatctgtccagttttattcccttgctggtaaggagctgtgatcctttggaggagaagagacatattggttttgggaatattcagtctttttgcacttttttcctcatcttcgtggatttatctacctttggtctttgatgttggtgaccttcggatggggtttctgtgtggatgtcctttttgttgatgttgatgctcttcctttgtatttgttagttttccttctaacagtcaggcccctctgctgcaggtctgcttgagtttgctagaagtccactccagaccctgtttgcctgggtatcaccagaggaggctgcagacagcaaagattgctgcctgttccttcatctggaagcttcctcccagaggggcacctaccagatgccagccagagctcagctgtatgaggtgtgtcctctcttaccactcctattcaacatagtattggaagttctggccacagcaatcaggaaagagaaagaaataaaaggtattcaaataggaagagaggaagtcaaattgtctctgtttgcagatgacataattgtatatttggaaaaccccacagtctcagcaaaaaaatctcccgaagctgataagcagcttcaacaaagtctcaggatacaaaaccaatgtgtaaaaatcacaagcattcctatacaccaataatagagaaacagagagccaaatcatgagtgaactaccattcacaattgctacaaagtgaataaaatacataggaatacaactcacaagggatgtgtaggacctcttcaactagaactacaaacaactgctcaaggaaataagagaggacacaaacaaatggagaaacattccaagctcatggataggaagaacgaatatcgtgaaaatggccatactgcccaaggtaatttatagattcaatgctattcccatcaaactaccattgactttcttcacagaattagaaaaaactactttaaatttcatatggaaccaataaagagcccgcatagccaagacaatactaaacaaaaagaacaaagctggacacatcatgctacctgactgcaaacgatgctacaaggctacagtaaccaaaacatcatggtactggtaccaaaaaaaatacatagaccaatggaacagaacagaagcctcagaatatgccacacatctaccactatctgatctttgacaaacctgacaaaaacaagcaatggggaaaggaaatccatacttcatcaatggtgctgggaaaactggctagccatatgcagaaaactgaaactggaccacttccttacaactcatacaaaaattaactcaaggtggtttaaagacttgaatgtaagacctaaaaccataaaaaccctagaagaataactaggtaataccattcaggacataggcatgggcaaagacttcatgactgaaacaccaaaagcaagggcaacaaaagccaaaattgataaatgggagctaattaaactaaagagcttctgcacagcaaaagaaactatcatcagagtgaaaaggaaacctacagaatgggagaaaatttttgcaatctatccatctgacaaagggctaatatccagaatctacaaagaacttaaacaaattaacaagaaagaaacaaccccatcaaaaagtgggcaaaggacatgaacagacacttctcaaaagaagacatttatgcggccaacaaacatgaaaaaaaaagctcatcatcactgttcattaaagaaatgcacattaaaaccacaatgagataccatctcatgccagttagaatggcaattattaaaaagtcaggaaacaacagatgctggagaggatgtggagaaataggaacgcttttacactgttgttgggattgtaagttagttcaaccattgtggaagacagtgtggcaattcctcaaggatctagaaccagaaatatcatttgatccagcaatcccattactgggtatatacccaaaggattataattcattctactataaagacacatgcacacatatgtttactgcagcactgttcacaatagcaaaggcttggaacccacccatatgtccatcagtgatagacggataaagaaaatgtggcacatatacaccatggaatactatgcagccataaaaacggatgagttcatgtcctttgcagggacatggatgaagctggaaaccatcattctcagctaaccaacacaggaacagaaaaccaaacactgcatgttctcactcataacggggagctgaacaatgagaacacatggacacagggaggggaacatcacacactggatcctgtcagccagtgggggataggggagggatagcattacgagaaatacctaatagctgtagctgatgggttgatgggtgtagcaaaccaccatggcacatgtgtacttatgtaacaaacctgcaggttctgcacatgtatcccagaacttatatatatatatatactgtgctgggatcacaaagaataaactgtgttccagtgctaaaattctgcttacagtttaagaagacacaatttcaggatatactatgatacatattatttgtgataaaaattgaattgtgttttataaatgtgagatagaataattctgccacaacagctgtgcatattaaaaagttatgtagaaccctacattaagcaattcatcattgctggcagaactgcaaaatggcacagtcactttgaaaaatagcgtagaatttatttgaaatgttagagttaccatataacctagcaattccacttctagttatacatacaaggtaaatgaaaacacatgtctataaaaaagcttttatatgcgtgttcatagtagcattattcataatagccaataaatgaaaacaacccaaatatctattaactaatgaatggataaataaaatttgtacagccatgcagtggaatattaattggcaatatgaagaaataaagtatttataagctataacaaagattaatcttgaaagcaaaagaccccatattgtaaaatttcagttacagtatatgaaatgtccagaacagcaaatccatagaggaagaaagtagcctggtagttgccagggccttggaggtggggcaagtggggaataattgctaatagatacagagaagagggtgatgcacatgatctaaagttagatggtggtgaaggttgctcaactctgtgaataagctaaaaaaaacactgaactatacactttaaaaggtgaattttatgctatttttttttcttaatacagttgttatgaaaaactgtaaggaaaaaactatctaaggtatttaaaaatcaaaatggaaaataactttcatagaaggttctatttctgaagtttaatattttcaattctataagatatatatttcaattttaatgaaatttctgctgtacacttgggaacttataacattataaatgtaatcatttcaaagtattttatagaatcacccttctcccccctcccttttttttgggtttggtgaccgataaaagtaaattatttcttgcccttgtgcagaagtttgaagtatccctcggggtaggaatcacttttaaaatgtcctactgtttcactgatggtgctgtattcttaaaggacactgacaaaaaaataatgtggcattacctgggcgaaggtcatttccttattaataattctacaatatcctggtactttcagagtttcatttttctgccctatgaaagaccaaataaaaagcctaaaatgctgacagaatagaagtcaaaaactcttgaggtggctgtaatggacaaataaaaaaaaatagtccacactattttgagtctggcactatgctagacactttggaagaaggggtggttttaaccacagtgatgctgattacctagtggggaaaacaaagcacgtaaatagttatatacaatgagacagaggctagtgatgaagatgtgtgcaaagtgttctaggaacactctggaggaggtgggattaatggtgactgtgggaggcagaaataccctcaaagatattaatattttcatgttgtacaataatattcaaaatttttccaggcttcatttgccataatgaatttatacaattaaaattcacattctgtaatttaagtatactcccatgaattcacataatagcactattcattagagtactacggaaatgaattaccattaatattgagaatatacatgctaggccagacccttattctagcaagagaagcatttgaccaaacttgatctcagcttttaaatctctactttggcataatttaaaacttcatatgttaaatatctttcattaaaataaaaatagcattgctaattttaaattcccatatttctattaaggctataagttgtgatgattttcatataactaattttggagatgaaatttaactacatgtatcaaaatgttttaaaatgttttctttctttgaatcagtaattcaaagaaagtgattcagtaagtgatatgataaaattaacaatataatatatagctacaatataattatttcaaggatatttagagacataagaaaatgcttattttatatagtaggtgaaaattataggctaaaaactactttaaaattaatgattcaaattatttttaaggccaaaaggaaatcactagcttgagctatatttcaaaaagccagcctagtaaatgagtatagggattatgaagtttttgcttgtcttcaaatttctaattcaaagtgatacttccataaatgtgaacccaatgcattatctagtcaatatatgcacttttaagaagacatctcattttattttagttgttctcttatttatatcgtttttgtacaggttatgtttttcttttcatcatcatttagtctttttttaactccttaatacactttatataattattcttacatattacatactcaataaatatatattttttaaaaatccttaacctataagttagttgcacctgtgtcacttccaatatatttttcctctagtgctaagaaataaaagagtactttccccaaataactcactcagatatacaactctcacctcaaatctgtcaccccttttgtgaatgaaaaatatttattttaaaactctgtgctctattaacttcagcctagatctaaatgttgtgtgctagaacacaaatgaatcacaagttcacatgaaaatttgttttaataaaggtatttcaaattttgtgcaagaaatgtataacacaagtcacaaaatagtaaacaaatcacttaaaatataagtttctatgagacgataaaatgtaaatttttgccattattgattgcaaaatatgaaagtctgaaactgcaaataatttgacaccctttatttaaggaacattgaatgttaaatgtataataatataagcgacataatttttggaactaaatgacttggcaagttccattaaaacagactaagtaccccatctgcaattaaatttattaaattataacacagataattccagcatatatgaggtcattctgaaagaacattcctattttgactttacttttcatttagctcattgtacacaatctctgatatattatcatacatttttagcgttataaattaatttttaaatgaaatgtaacacataggattaatagtaaatataatttcactatatttcaagcactgttctaggcacttaatatgtatcagcttattgactataaacaataaccatatggtgttgctaccatgatgatcccattttacatgtagggaaatagtggcacaaagagtttaagtgattttctcagtgccttacatgccttactgtcttatgtggcagaattagtactcgaacccagctagctggtaacaaaagttcagtttaatcactaagactgtacttctactttcattttattattataacatgaacattgcaacataaactaatatgccatgcagaaaactttcaggatattaacacatataaaacatttaaaaacatagtatttctagaaattatattattgatagaattttcaggtacaaattgccttaggaaaaaattctatttatgataaacatatgccaatttttttaactgcagatttttagtgatagatctattcaataaatttgcacaaagattttcaaatttagatgctggatatttaaatcagcttgtcattacatcctaaaactaataagtatgccatgctttatccatgtaactcatatcatcaacagtaggacatcagccacacaacttcagtttagaaaagtagtactcatatccactcttggctgacagtaatcattaaaataataatagatgataacattttttagtccacctcaagaaataatttttatataactgtcaactccaattttttgatgaggaaataaaaatgaaactaaaagaaaaatataagatcttaattgaacctgaaaacatatgccaatcaactccatccccttcttatagtcaaataataaaccatataaagccttggtaccagatttcttttaaaaatacattaatccctttgtttactcaatgcatatttacattttgcaaaacacggtgtgatttctgtccttagaaagtttcccttaggaaagaaaaacacgtgatcatgcatagcacagtgtgttaagctttggagcatctggaacctcaatttgccttgactggactggcctagaatatccactggagtgagttggttatctgtctatttacatgagggagaaaggtgacccctggaaagacgaagtagcaaggaggttaaagtctccagctctcgaagcaactgcttgttatttgaattccagctccatcttttttagctgtgtgttcttgggaaatttagtttaccttttttgtgttttatcttattaatctgtaaaacacggataacagaaacaagcaaagtcttactgggttgttgtgagacttaactaagttattcaggttaaatgcttagacaagtatgagcacttggtaagtgttaacaatgaattactattattattattattattaattactggaacaaactcaaagcttgtatttttaagggtgggagggccttgtcactggcgattctaggagtaagctgtatgtctccaagtcctgccaatctataggtaccgatattgccacatagcagtggcaataatcagcttccatggctgatatctcacacccatgctttcagaattctatcaggcccactcttaggattctttcacagtcaattccagttatttctttaaggcaagaaacaaacagtgtaggcataatatcatgaaaatgacagatgtttaatggccattgtgatatctgaaaaagctgacaaaactatatggaaagaataattaatataaatgaccatagaaggcaaaagaaatatatcatatttaaaggtaatctgaaatgtgtgtgaggacaatgaggcccataatctgattttatgtttaacatctgcatttccatttaattttgtattcattatcacttttaaagtattgatttaaaaagccatgtaatatagttagttagtggatacattagttgtggccgataattcctttatttaaaccagagaaagtagttttcctatgtaacattactatacataacagttagggaggtttgatggtctatatttcattgtctgttcctgttattttattattccagtttcttgttatatttgcctttggagaatagaatcagacaaacatgaaacctttgtcatatacagaataggaccataataaagccagaatgaactccgatttttattgacaagtgagtaaagtgtactacgttctcatctgtttcctctctctaccaccacaattcttttcacctgacattttgccatttttgggaggttttcaaggatcatatcctatgcctccctgctctgtcataacaggggatttcactgaagttacccccaacacacacacaaacacacccacagagagacaaaggacaatacaaagctatctccctctctttctgtcaccatatccattatcatggcacctgatactatctgagtgaattctgtcactcactcaaaagcccacgggccttacagcctactcttaagacactgattttactaattttgcattgtttcttctgtttaaggtgctcttccttgccctgtctatttggaaaactcttcttcattctttagggctttgatgtcacatcccctattctaggaagcctatgatcttcagacaaaatttggaaacctctcctcaggtttcccattgatgagaatatatatttatggggctataattttttgtacagttgtctagttcccacacgagaacacatgactctgaagggatggatggtcctttcattttaaccttctcacaacaatgtttctgaaaagggcagggtcttaatgtgttagaatgaataagctacctaatggaatatatgtatacaattaggcacagcgcaatgattctatgactgcaggttagccacataaacaagtatctgtcctatttcgacaaattaggccagatcaccaatgcccaacttttcttggaccagatataccatttaccatattctcaatatgtgctgacttggtaacattgagagatacaaaaataataaactacagtaattggaattattaatgactcaggtatttcattaattttaggcaaagtatccttaaagcattggaaagagtttaaaatttagttccctagttgctcagtattctaatatctatttctgtatctatatatacatctaataatatatatgggtgtatatatattattaataggtaaaatattcataatagatcattattttttaagtatttcacaaaatgctttggaaggaaccgtaaaactcaagatgcattccctatgatcaaggacattacttttagctttctttatttgaatgtttgcatttgcacatgtttcaatgcacctgttgaaagcaaccaaaataacacagagaaaaatcattagacagttttgattatgaactgggagaaaaagaatgtagtttaaaaaattaaccttttccctacttttctcttagttaccatactccactgccacacagtacagaaaagaaaaaataaatctatctttgagaaatgtttcattttcacttgaaatgatgcaattagtcactgctccatatatttgtgtttgaaacgtttctatcaagtataatcttagccagagcaccctatagtgtacaagctatacatgaatagtgaaagtattgtatttgttatttgaaatgtgtcgatgcagcacacttaattcaaaacatttatgagtggaggttgacaagtctgtccttctaactcttatggcataacttactatttatatgctacctgtatttcaagatccattctgtgttctaacactatagagaaggccaattgaatattccctcagatagaaatgaaagttctctctctgtccatctatctatttttctatctctttttcttattattacaatctttcttttgtatgtatccacttaacccattgtaacattttccccattataagacctagcattcctcctcttattaagaataaacaccttagcagtattggctacatggctgatgttgaattaagcgaattaagttgttggaaacacacaattcaaatttactatgtttgtgaatccaaagataggtttactcgtggagttttaggagttataaggtcagcctttggaaaattctgaattcgttttttaattatttcctgcgaatattgctttgtaggatatttctagaaacgcaacccactgaaaatagccaatctaaacattacaatctcagcataaacatttgcctcagtggaagtccttaattaccaaatggagagaaatgcatgcaggctgtcagcatcatgtttctccttggtagtgtctctcaccattttgccaccacgaatgtttctaaatggccaacatactacttcttctcatttgaatgtttatgtttgagaaaatgcaaaaataagagcactaagtgcaaacagaggtttgctgaagtttgtgtatttagctcctatggcgttctggatgccagattcacattcattagacataaattgatgttaagcagccttgactgcaggaggaaaagcaacaacaaaaatctcttcatacctctaagactttcagtcagattcttttcttacagaaccccattctgccattccagcacactgttttctgttcagtcttatcagtcttttcctgctttattcttgttttttgactgctgtttatgccacttaggcatttgcttatactggtccccatagattttcctcctgtttaacatcacaatggactcaactttctttgaagcatacctcgtctatggaagcaaatgacatcctaatttgttaactctaaggcattacagaactttattccttcaaggcctctaactttacttttggccttatcttctgccatgtcccatctgaacacaatgctgctttcacctgttcctttatactctccaggaggactgtgcaattgttttccttctgcctgaaatactctgttctatgtcatcttctgagataaggcttcccttttcacccactctacagtaggtttctgcaactcatttttaccaattatgatctctctctcctctcatgttttaagacagttaccttttaatgtttctggaattactttttttgtttttttgctttgtctccactgtattgaaataattgccaatccaggtttcttactttcaaaccttcttatatttaattcattttacaggtaggttattacttatcacaaatccttgtttggacattttatttcctcatctccatttatttcctcattctccccaaaaaaagtcaccccaccatttgataaatccctcatgtttagaggataaaatgaattgtctttatttattgctagagagtgaatgtgaaccctcaaaattcatttgttgaagccctaagcccgatttgatgggaatttgaggtggggcctttgggaggtaattactgttagataaatccatgagggtggagccctcatgatgaaaagaggagacatgagatattgcgctctctctctgtgccacgtgaggatacaataggaagcagactctcaccagacactggatccaccagtgccttgatcttgaacttctcaacctccagaattgtgagaaataaatagctgtttaagccactcggtccatggtatttttgtcctagtatcctaaattgtcgaagacagcactttatcaaggtcatcatgtactagtctttacctatagccctaaaccaaaatgtctaatacttctctaaaaggaacactctgcttcagggaagaaagaatgtttacaacatttctgctgttcaatttagcctcacatcatttctcttgcctggaacattatcttattcacccttcaatgtttctaaatcctatatacttaatttaaggcctagttcaagttgtagtacttcattgaatacttctccaattgataatctttcaatttttattcataattacaagatcgaggcagaaagagttttgtgtgcctgactttgtagacttagtaaaaatagcttcaccatttttttttaggaaataaaagcataatgtaagtactacacggcttatgtttgatataataacatctgcacaaaaaaacccacaaaaagtctcaattactctttttttttcaaaagtttatcacattccttcatgcatttactaattcaaacacatttataggtttccttgaagaggtccaggcattctgccagaaaatgggattatagtagcagactaaatttagtcaaaacagatcaaactccttgcccctagggagcttacatccttgcagggatgatagtggggttggagaggaagacattaaagaagacagacaaatacagagtgtgttacatggtggtaggtgctatagagtaaaataaaacggggaggggtggagctgcaatctagatagagatggcagaaaacacttaggaggagtgtggcatttgagcaaaggcctaaagacagcaagggagtaagacatgtgagtagataaggggtagttggaatatttcagagatgacagagtacttgaagcagaaggagccatgaagaggagaccacatctcagaggtaacttaggactcaagtatgcaggactctatgggctattatgagaacttggcttttgggaagcaaatggaagatttagagcaaaaattgacatggtcagatttctgtataaatgtaatcctttcagctgctatttgaggaacagacttaggtgaggcaaaagaggaagtaggaaaatcaatgagaggactattgaaagaatctggaaaaagataaaggtgacttgaacctaagtgttagctatggaagtgattgaagtagatagattatgcatatgttttcaagataatgtcagcaggttgaacaattatatgtgggtgagagataaagaggaaagtcagagatgatggaagatgactcagagtttttgccaaagcagctggaacataagaagagagattggaaaaattatgagaaaaggtttggaatgggaaagggaattaggaatcagtttttgatgcgttaaattgagatgtcaattagacaactaagttaagatacacatttttggtgtctggagtttgggagaagggtccaagttggagacgctaatatagaagtcatcatttataaaaaggtacttaaatctctaattcagcccaaattgctaaaggtatgagatagacttaatacacagagaagaggttcaaggactgagtcttggtacacttctcagtgttcagatgctgggaagacaagaagagagctaatgaaagatactgagagagtggctattacagggatgggaaacaccagagaagtgtgttactgggagcctggaacatgttacaaggaggaagttactaactctgagaaatagccctgaggacttaaaatctgtcaccagatttggcaacacagaaatcactgatgttgttaatattgtcaggttcactgaagagatagggggcaacagcctgggaagatacagaagagaaaaattggagataatgggcattcaaaactttttgaatcactttgctgtaaaggaactgatagaaatcaggatggaaggtaactagtagcacagatggaattgagtgtgtgtttgtgtgtgtgtgtgtgtgtgtgtctatatatatatatatatatatatatatatatatacacattggaaaaaataacagcattttgaacatagaaacatagatgaaggcaggtggggagatatgatgttcagagatgctgttttctcagagaaagaagcagagtcaataagaaaataaacatgaaaaagttattattagaaatttcagaaaaagcaaagttgaaaaagtgtcatttaggttagacctaaaaccataaaaaccctagaagaaaacctaggcattaccattcaggacaggcatgggcaaggacttcatgtctaaaacaccaaaagcaatggcaacaaaagacaaaattgacaaatgggatctaattaaactaaagagtttctgcacagcaaaagaaactaccatcagagtgaacaggcaacctacaaaatgggaaaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagtcaaaaaacacatgaaaaaatgctcaccatcactggccatcagagaaatgcaaatcaaaaccacaatgagatatcatctcacaccagttagaatggcaatcattaaaaagtcaggaaacaacaggtgctggtgaggaagtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatttatgtttattgcagcattattcacaatagcaaagacttggaaccaacccaaatgtccaacaacaatatactggattaagaaaatgtggcacatatacaccatggaatactatgcagccataaaaaaggatgagtccatgtcctttgtagggacatggatgaaattggaaatcatcattctcagtaaactatcacaaggacaaaaaaccaaacaccgcatgttctcactcataggtgggaattgaacaatgagaacacatagacacaggaaggggaacatcacaccctggggactgttgtggggtggggggaggggggagggatagcattaggagatatacctaatgctaaatgatgagttatgggtgcagcacaccagcatggcacatgtatacatatgtaactaacctgcacattgtgcacatgtaccctaaaacttaaagtataataataataaaattttaaaaaaaagaaaaagtgtcgtttaggacatcagtcttcaaacatgtttgctcaatcatcccctaacagaaatttagcaactgtgcctcctcacacatctataaattaacatctaaaatttgttattctatgtttacctgaatgccaagtatggaatttctgatataatgtaaattttggcatatatcaaattgaatcataacatttttgctattctaccctcaccattttacatgaataaaaaaaacataaattcttctttaaaatagaaaatttatatttttttattttgcctaaattgtagttcctttttttataacacagaaaatatttttaaacttaaagccacttactgatcacctaacataattctctgcaataaatacacttaaatactttgattttaaaatgtgtagggctaggtatggtggctcatgcctgtaatgccagcactttgggagactcaggcagaaggattgcttgagcccaggaattcaagatcagcctgggcaacatagtgaaaccccatctctacacaaaatacaaatacaaataaaaattaactaggcatgatggtgagcatctgtagtcccagctactcaggaacctgaggcaggagaatcacttgggccccagggtttgagcctacagtgggctataattgtgccactgcactttagcctgggcaacacagtaagatcctgtttccaaaacaaaacaaaacaaaagtataatattataaggctccaattttaaaatgttcttttgtgtttgaattctcataaattattattaattgaaaatgttaaaaacacatattataaagtttaatgtttaaatatgaaagacaggaagtaaattttattggcaatatatagtataatgacaaagataagaagtgatattatgacttaattgagaactacttcacagatgacaatgcagtgttttgttgtattgtttggagacccaggagtttttataacttagagcaatgcacaataaaagaatttgggatgaatgaaagtgatgcatctcctccctcctccgcttctctcttttatttgaaggagataagcattttaaaatggatatgagaaaggtgaatcaactggattcttcaataggcaaatcatttttaggaaaggagctcttagaagttttaaattatccacaagcaatgtgtgatccgtgatttaattttggagtgaattaacaaaaaactataaagaagaagaatatttttggagacaattgcagaaaattgccaatatattagataatgctattatatcatgtgaaatttcttgggtgtaataatggtattggggttataataggagaaagtcctcatgagactttctgaagtcactgaagagagacactgaagactttaggagtgatagatcatattttctgctttgtagtatcaaatatgtcagcaaaatgtgttgaggaaagaaatagatgaggtaaatgtggcaaaacaatcataaatccacgtgaatgaaaggaatcaataacaatactttctgcatactctgtcagctttaatatacaagatcagagagtccaatgtttctaggctctaaccctctgggatagaatgggaaaattcaacatgtagaaataaaactgaaggaatatgctgagtaaatgtatagcatgggaggtcaatgttgttacatttatatgagtaaaaccagaagaatggtttaatatgctaaaaatgggagccaactttgaggcataaaaataaatctgagaagttggatatcctatgccacagaccacagtctactcttcttgagtatgacatgccccagagcaaataaagcagacacgagaggctctaaaatggctttagccctactgaagctccatctacctggaggaagggtttacaatttttttaagtcaacaatcagtaataaaaagttgtcataattaaaattcccaaataataaaggtcaacatatatgtcctaactcatgcttggttcttcatgcatatgagctgcttgccagcagtgccacctccctagagacaaccaaatgtttaactcaccaatgacaagtgtgacttcagaaataatcctcttactgatttttatttgtgataaattaaaatgataatagaagcaattgcaccaagcccacattttcagatcattttatgattatttgtggctcacgagatgcttctaaatttctaactgagaccagtgtcttccttttttatctttccaagattatttgtaaattactcctttctattaattgtctcttcattagggcaaagttttcttatacacttttggtatatgagttaacataggaacacataatagagacagaagtagaaaaagggtctcctgccttccccatgttagtctttaagtgacatccctatttcattgatgtcttttttttttttttttttttttttttggggcagagttttgctcttattgcccaggctggagtgcaatggtgcgatctcggctcactgccactgcagcctcccaggttcaagcgattctcctgtctcagcctcctgagtagctggcattacaggcacacgccaccacgtccagctaattttgtatttttagtagagacagggtttctccatgttgatcaggctggtctcgaactcctgacctcaggtgatctgcctgcctctgcctcccaaaatgctgggattacaggcatgagccaccacacctgaccctcatagttgtcttttttgatgttctgaaatataacctaagttctagttctaaagagtttccttcaccttccatgagcactgctcagtttccttttccataatttttcctttcccaggcctttcaattaaattggtttggaaaagacacagacaaggaggagggcacagtatcccaaatgctgataacaaaccaaaaaccttaagggctgctgttctgcaaatttacagagttggcatggtgcaagaaagcaagctgtagtctgtcacagatttttttctcaaatttagtttgaaataattttagatgtataaaagagttacaaagatactacaaagagttctcatatactctttactcagcttcacctactgtttgcatcacacataatcatggtacatctatcaaataaattaaaattaatgaaaaactacagactgtcttcagatttttcaatttctactaatattactctgttccaggatccaattcaggatacagatgaaatgttgtatttcatcaggtctccttagtctcatctaatttgtgacaatttctcagtctttccttgtctttcatgatcttcacaggtttgaagagtactggtcacataatctgtaaaatgtccctcagtttggatttttctggtattttttcatgattactcatgattacactgtgaatttttggaagagcagcacagagaggatgtgtccttcttattgtatcctttcagggaatacagccatggggattttatttaacttattaatttatttattcattatttatttatttatttattgagacggagtctcactctgtcacccaggcttgagtgcagtggcgtgatctcggctcactgcaacctccacctcccaggttcaagtgattctcttgcctcagcctcccaagtagctgggattacaggcacacaccaccatgcttggataatttttgtatattttgtagagacggggtttcactatgttggccaggctagtctcgaactactgaccttgtgatccccctgccttggcctcccaaattgctgggattagagacgtgagccaccgtgcccggcatcatggggattgtaaaatgcatgtttcccattgagaaagtgaggtaaagaaaagaactgtgcatcaagcaatagaaaaaaaatcaatattctgtttttactggcacttttggcctgctggccataagccaatactataaactagcaggtagggtgctgcaagaatgtcaatacttctgccacattaatctttgcaggcttgccgcccctgcagttaactcatggagcatcctttgccaggacatacatctgcctctgtaccatgcccctgtaatgtgtcttcaaagggtgcaccattccacatctgttctctatcttttatgaccaaccactacaaaaactagagagaatccccaactgtttgttttctttcgttccagttaagaaaattgatgataatctcaaaaaaggggctattaactcttattatctctttcattttatcttcttcctctcttttaccctacatctgagcagggggccatggttagaagcaatgccttcaggaagtacgcactctttcccaaattaattctcatcatggaggtataggatcagctaataataattatatttttgaggaacagagaaagaggacaaaggggagaggagtcaccacttataatccctaccaggatagctttgtactgtgctaaacactttttgtcagatcccatttaaatctgagatgcctataaggtaagtatcattttctctatttgactgatgagaagagtggacttcagtagaatttaaaaaattcttcaaggttagctggttagtaaatgagtagagaccacaggtcatagtattttctctctccctcacctggaagaataaatcattcataccacctcagtatgggttaaagccagacatcttgtcagtgcttcctaaaaaaaaaagaaagaaagaaaagaaagaaattgtttttcatatgagattctgtgtctgggtccctgatgatttcctatgcctaagtatctacttgataatctctccaaaacgccactcttccaacactctgtgttgctattttcagtcctctccaggaactcttaaactaaaggacatgacccccatgcactgacaactacttcagccacctcaactctgaccagtccctcaaagcaggaagccatctgttgttattttcaccactaacaaatattcacggcctcatgttttcccggcacatagtgaacacgcacttatcttccccctttgaaactaggtgtggccatattcaaatcaaaatcctgccctttggtagttataagacacacaaaaaaactgaggcaggtattagagttagaattctagtctctctggcccaaactctgacctcataaccactgcaagataccctccctatcctatagagcctagtactacactaccccctcccaactttagcctccacatatagtaaagtgcttggaacacaaaaaacacttcataaattgtgctgaatgaaatcatttccatgagtgtttatggattttgagttcatttgtaccttttacctaaaattctagccactttaatttggagagtttccagagcaaagggcacagatcccaggcataacaacgctttgcgtatacagcaaccaatatcttgtcaacccaagaaagttcctccattgatacctagtagaaatagcccagtttttaaagtcctcaaaactgtaacaaattacttgtttttaaaatttaacttaaattaatacaatcagatttttgtgttatttgggtattagagtatgttaaagcacatatatcccagagacatagagtttccgtttcaaaaagtcatgcattcatgtgtgctaatgacaatcctatcctgacccgctatgtgacttgtatctctaaaccataggctttcctgaattttatctgttaatttaaccctgatttctcagcagcagcttctctttgtaaatagacttgcctcttctgtgtctgacctctgctcctcataatcagattaactcagataaagctgcttcagggaagaggtcaaaaccgttgccaaaaatagtagttgccctacttcagtctattttcaacagagtagccaggagatcctgttcacaccaaagtccaatcagccctactgttagcactctgctcacaagcctccagtggcttccgacctcactcacagtaaaagccaagtcatcctttagcctatgatgtcctacatgatttgaattcccttccattgatttttgtcactgatttttaaaaatccaaattcattctcatacagctgaattgtcctctttgctttaagtatgccaggattatttctacctcagggcctttgcacttgatattcccttcaccttttccaagatagttattccctcacctcagtcaagcctttatttagatgcccccttctcatcaaggcattctctgatctccttatttaaatgtatgacaccccttctttgctttacatttaatcagaacatgtatcactatctagcatataatacatttgcttgacctcttttgtttactgtctatgcctcctgaatactgtgtaagctccatgatacaggcacttttctctatttcgagcactgttgtattacagagccttaaaagtacctggcacttactagattaccaaaacacatttatcacacgactgaaaaagtaaatgaatagacacatcattattgatttttgcaaatgtttgaggcatgtattattattacccaataatgctagccagctaatacagctaattttatgtggtcatatttactaaaactttacacttttgttagaggtttatcattagtatttttattttcaaatgaagttttaaaaagaatatgctaaaggcagtattcttttcaaggtgaaagttggctcttaggcatatgtaatgctcctaacactgctattgtcaatttgttgctaagaaagatcaaaggagaaattgaaagccaaggatgcatagagctaggagatattaatgtggctttgaagaggaatatatccgagccctggcggtgggagagtttcataaaatagggcattttctctcagaaaaagggacgtgcagttttcggaacacttctctgttttccagtggaacaccatattttcacagaaaccatgccctgacctgatttataattttgagaaaatagttcaaatgcccttttctcattatgagaagatcatactgctgccaccacaagcatttcaccactgataattttaatactgactctcagagaaccaagtaagtagttgaacttaattccccagaaattattttgcaagaaaatttaccagcagttgctgcctacataaaaacgatatggaactgcaaacttgccatttaagaatcagccttttccctaaaacaaaggaaaattggttatagattaagaaacatttgtgcaatgtagaatcagttttcagttctggctgcatgtttacctgggaacttttgaaaatattagtatgtggtatttcatgtctatacttctcccacttccaaagatattctaatttagtgagtcttggtaggtcctagtaatcactatttttgacaagttcatccaaacgatttaatgtgcaactaactttaagggaaacatgtagtgggagaaaatgtatacaggcatatctgcctaatactcttcattgatgattcattcgttcatcctaaattacatcaagtacccactatgtgctaggaactgtgctaggggaaaaaggtgatggggtttagactgtagtctagaaaaaataacattgagcagaagagcagaaagtactactcaaatgttaataccactgctacattaatctcaacaacacactattgataatttctttccttttatcctcactcaagttaatctaatttatttgtaatcatttatctaaataatatctaagatctagtataactagtcatctataatctaatgcaacttgtaccactccactgcttccctgtttggaatgcctcctctaggacaaaacacaccctccatcaaaagccgtatgtctatggaaattttaagagagacagaggaagagaaagagaattcaacttcacttcaaaaccagacaaaaactctccacttcaaaaccttgcatatggattcttttctctagactaaacattcccacttcccataaataacacttctttctctctgatgagtcctttctgcctctccctcccactgccactgccctggtctggagttcctccgatgaggactgtggtaacaaccttctaactgatttttttaaatttttttatttttatttttatttttccttttagaagcttcaccctccaaatagtccttcactattccaagaatatctctgatatccagatctgctcatccacgctgtccaaaaaaacaaaacaaaaaacaaacaaacaaaaactctgtcaaatttccaccatccacatgataaagaccaaatggttttcccactgaccacatcataagaccaagtggtttagcatgacacacacagtcttctagaacttgactctggtcaaattctccagtgcagctctagctagccaagtctagatatacaggattactcatccttttgttattttgctaaaaaaaaaaaaaaagtttcattccatgaggaaataaaagaaaaaaaaaactttttagtcatttatgtaaatttttataaacttatagataaactgtgaattaaaatctagttttgtacagtaattaattatctctggtccctaataagttgagcacattgcttatttttctctagttataaattttatatttaaaaattgacctaaaagcctaaatagccatgtaaatgcatatgtataaacaaggcaaagctattttaagcagaatctacaatgtatgaaaaactggggcaaactaagtaatgcttagtcttaagactcattaaaaacaaaattctttttgttactgtagcatttaaaaaaatacaatttttaattgtatttgagcaaatacaattaagtacaattaaataaatttaatttgagcaaaacaatatatttaaaataagatgattaaagttagacagtgatatattggagacattattatttgttttgagatacttttatgtgcagctaatgagaaataattaaattataaagtaattataaataaattaggtatttcccatatatttaaaagtcttaatcaatgcaaaattctcttcctcataaattcttgaagctcagagataatggaactatggaaagaacaggcaatctatagaatgggataaaatttttgcaatctatccatctgacaaacggctaatatctagaatctacaaggaacttaaacaaatttacgagaaaaatcaaacaaccccatcaaaaagtgggcgaaagatatgaacagacacttctcaaaagaagatatttatatggccaacaagcatatgaaaaaaaagcttatcactggtcattagagaaatgcaaatcaaaaccacaatgagacaccatctcacaccagttagaatggcgatcattaaaaagtcaggaaacaacagatgctggagaggacatggagaaataggaatgcttttacactgttggtgggagtgtaaactagttcaaccattgtggaagacagtgtggtcattcctcaaggatctagaaataaaaataccatttgacccagcaatctcattactgggtatatactcaaagaattataaatcattctactataaggacacatgtacagctatgtttattgcaacactattctcaatagcaaagaattggaaccaacccaaatgcccatcagtgatagactggataaagaaaatgtggcacatatataccatggaatactatgcagccataaaaaaggatgagttcatatcctttgcagggacatggatgaagccggaaaccatcattctcagcaaactaacacaggaacagaaaaccaaacaccacatgttctcactcataagtgggagttgaacaatgagaacacatggacacaaggaggggaacatcacacaccgggccctgtcagggggtggggtgctaggggagggatagcattaggagaaatacctaatgtagataacgggttgatgcatgtagcagtggtacattcccacttccaaatatattctgatttagtgagtctttgtacgtcccagtaatcagtatttttgacaagttcctccgaatgatttaatgtgcaactaggtttaagagaaacatgcagcaaaccaccatggcacatgtatacctatgtaacaaacctgcacattctgcacatgtatcccagaacttaaagtataattaaaaaaaaaaaaaagaaagaaaagggaagaaagggccaaactactcaaaagaatgctgaaaataagaggttcagttgaatatgttgaaagtaatggtagaggggctgttaatgcttcatcttggcaaagacatagaaaatcttggtgattaatcaaaaggtcagaatccgttactctatttcctttccaagtgttttccccaggatggtttttgtttggtgttttattgagctcttgcttcctctgcaagtgagcctaatctatatgcagctctggagcaatgtctagcaattgattgttattttctggactctggctgcaggcttgtccatgaaagttggaaggtctaccacaaaattgcaagtggaggctcagtgctgaccccttctttttcctccacctctgttccacacaatgagttccctcttgtacatgtgtatgccctgagccacatgtaccagcttctcaactacaagcagtctccttttggctctatggtcctaaggatacatatgtcagagatgaggtttgcagacaaaggaggaggcccattcagtccttagaaataggctcagagcattggattagggattttcagggttcctggtacatgcagatggtgtagaagaggtaatgggatactgaattggatctagattcttggcctcaggaacatctgttctagtggtaaggaatgagaccaaaagaagaccagagcagggctgaagcacagagcatccgacagggttgcctcgattttctcacgtccctgatgtacagtaagcatttagtaccaataagtcatttagcagctgctgtatcatgaaaatgtttccatgctggtggaaggaaccagaatgaggatgtcagaagttatctgcaaagttacattaggcttatacaatattttttgtactcatatttctacaaagacctcagttataacttttattatttgcttatgcctatcattccattagaatacttcttttctttcttgtctgcctgaaaattttgcaagttttctttaaaagcccaggtcaaacttatactctgtatgaaactttccccaatcttccatcagcagaattaacttatgtttagatagcactttatacataactctaacttaacactgccacacagcattacatttaggtatatgtattttctctattagaatataaattcactgaacacatgatatttgctcattctttctttaccccaaaccaaatacagtatttggtatatacaaaggatacaactaacttttgatgaattgaattaaacacatatgttaagtttcctattcctacactgttttgtttatctttttcttgaaactaacttttgtcaagatcttttgtggaaaatgtgacagaatattctaggtattatgtaaccaggatggtctaaagtaggcaaattatctttattgattcagccaatcatttggaaacctttatttctgcaaagggccagatagtaaataatttaggcttttctgactatacagtctctttcctgccactcaactctgatgttatagcacaaaagcaacacagataatatgtatacagcaggcatggctgtgttccagtaaaactttatttacaaaaacaggtagcaggccagatgtggccctgatctataccagcacttcttaaacatggttacacaagagaataagtcctaatgctttaaagcatccaattacacactaacttccctcatacacatacagaatggtgatagttatgtactatcttaagagaattgagaaaatagttattcaaatagtatttttttttctatggttcagatgagcaatgctggctgacagaaatgcttatctagacactagacttccattcatagataagcctaagactatatgatatttttaacacaagctatcattggttcatattgattttctttccagacaaatccgcttaggtcttttatacttcagttgttttattatatctaaatggaaactgcatatttatcattattaattcttttcttgttggttttataaagaaaatctcccatttcttccataataaagcagtatttttttcaatctatatcttatgagcttgaaattgtatatatacaactaaaatccagaacataattattattaaaatgtctgagaaattgtttttaattgagttttatatgtacctcctaagtgactttttgtatccaatactccatccaagctctgtagatgttatcaaggcccaaaacttgaactctcaattagctcctctcttttattttttattcagtttgttagaaaagtttgttggatttatttttccaaacacatccagcatataaccactagcaaccatgctggtctgagtcatctttatctttcctctcaattactgtagtaacctaactgatctttgcttctgtccctgtctcctttagtctacgctaggcatactgctagaggagtccttttaaaacataaaacatatttgtctctcctttgttcaaaacccaaagagtaatcagttttagatggagaaaaatttatgagaaacgggagagacctgtccaatgtcacatagactggtaggtctgggcactagagcacaaacatctatcattgaatctgaaaccctatcacataaccaaaagtttctaaatgtaaattcatgtgctatttgttttcttagtattagacatttaaaaaaaataataccaaagagtatctactcctacttctgacataaataagtgctaagttccttagatctcaattctagtagtcacattgtattaaacttcagggtggggcattaactttattataggtacgcaatatataaatatatgtatgcttcttcatctctgaaataaagtttatagtataaatactatattcctcgtgtattatctgcaaggatcaaatgagataacatttatggtaagagctttgtggggccgggcacggtgggtcacgcctgtaatcccagcactttgggaggccgaggtgggtggatcacctgaggtcgggaggtcgagaccagcctgaccaacatagagaaaccccgtttctaccaaaaatacaaaattagcctggtatggtggcacatgcttgtaatcccagctattcgggaggctgaggcaggagaatcacttgaacccaggaggcggaagttgtggtgagccaagatcatgccattgcactccagcctggacaacaagagcaaaattccacctcaaaaaaaaaaaaaaaaaaaaaaaagctttgtaaaacttaaagaattataaatagcaagagtttactttctttttttttctctctttttaaaatttatttattattattatactttaagttttagggtacatgtgcacaatgtgcaggttagttacatatgtatacatgtgccttgctggtgcgctgcatccactaactcatcatctagcattaggtatatctcccgatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttacacatgcacacgtatgtttattgtggcattattcacaatagcaaagacttggaaccaacccaaatgtccaacaacgatagactggattaagaaaatgtggcacatatacaccatggactactatgcagccataaaaaatgatgagttcatgtcctttgtagggacatggatgaaactggaaatcatcattctcagtaaactatcgcaagagtttactttcacaggtatttaaagaatagaaataacgttacttcattgggatccaaaccaaagcagaaccttttgtccaattattatcagtgagatgtttgtttagatgtgtagatggtgaaactctagattatgccccttctcagtggctcacagacttccaaatattacacagaaattagaaaatggtaagagaaagaaggttttccattttagccatcatcttgatgacaaaagaccttcaaattttattattgaaagattcctatttcatcctcctctaacttttggactaaaagttgagaccagggtgaaataccaggtatagagcccaagtgaacaagcttttatttgcaggcatttatatagggtcttttctctgtcccaaggagattaggggccttggtgcccttgaaatctctgtcttcttcacccatattttcttgcttcaggaaaatacttcgaggtcttgcttctgaacctgctcactccacctaaccttttttttttttttgctcttgattcctgacttcctctgtggactcaaactatataaagtctgtccccatctcaaagttgtggatcacctctactcacttctacaaccatatatgctttctgtggacctagaacaggttggaattctgggaatctagcttgaacaagaaaggaacttggacgtcatctttaaagaaaatgttctcctttttccctgaatacaaaggactcagcatcattttggtgagaactcaaccttgcctttcttcatcagaagtaaaaagtgaatgtttttgaaagttcagaaccattctatgctatctgttagatgttaaaggcaactggaatttagaagaggagaaaagaacacacaccaaagataaaagcaacctcaccactccaactgcttaatttcctatgcttcacgttttggtttcttcagttggcaggttccaaaagttatctttacacatattcaaaatgtcaattgtatttcagaatccaaaaaattaatattttccaaacagctattatatatatttattatatatcaatattttccaagcagctattatatatatttccttaataacatatatacaaataaacagatgaggcaggcagatgcatacaaatgtgtgtgtttctgtatgtgtgtgtgagctccaatcacacttcccacaggaaccatacatttctcatgagctcctgtaatttgaactttaccaaacttgtcttcatactaacttttccaattaatcacatagaaactcaaactcgttttacatttgaatctggtaattgtgtaatctttatcagcagagcaaaaagctgaaataaattttaaaacaggtatatacaatatcatatctagaatgtattaattacttaggtatgagacactattcaaagctctttacagattttatttctttaattctaaagacaacatcatgagataggttctatgattgtaccaattttagcaacaacaaaggagatatggaaagtcacaaatgtgtgtggcaggcatagcaggaatttaaacagatgataaccctgagttaagaataacccgtggaatttctgatttgtgggtggaagaagaattctcactcttaactgttttttaaaaaattaatatagtgatgtactagttttgtatagtcatcataaaagaaaaaaatcttcaaagaaattgctattacaaacaaaatattcatgactaacaagcataaaaataaggccatgtctgaaatcatgttcacccacatgaaacattaaactcagaatcagccagggaggctgatgtgcaactaattagaaaacattctaattagttttctttatagttttccttgtttttcatctttatcctttccttaatcttcaaatggcagctgggtagatgtggtgaagttacatacacaacaataatttaccaggaaaaggaaagccatgttcaataagattttcattgcaagatacataacaaaaaaatctgttaattttcaagcaaagcaatgaaagctgaacactccctagcatacagagatgattctgaaaaatattgggtcaattttgtgaccatttttgacccatatctgggcattttccaatagtgtcaagagacatcatttacatttgaaaatgcgtatacaaaggaaaaaagaaacctctcaccactgccaacagacactttgtgatgggtgtgtcaattagcacaaacttttggaaaattattaagaaaataatacatcttcaaggaaaacattataagaaaataattagaaatgaacatcaagatttataaacaataatatccataggtaaaattgattaaaatgtaatttataatcatgcaaatttggataacataggaaaatatttcaaataatagtacatttttaaaaaggactgtacaggattatatctaccagtagatttcaaatacacaaaaatatattcaaagttgcatcaagctatttcctctatactgtaggttctgtgaggggaaaaacgaaaaacaaccctgatgtttactttcatacctttggcatctacatcagtatatggaacataatcaatgctcggtacaaaaaagaaagttaaatgatgaatgaatacatgtatttcccttcatatatattcaatatatgcctggtaagcagtcctttaagaacccaacatttccaagtcctgagctgattgtctaactgaatagaccaaacatttctacaggaagcagacagtgtctattcaaagaaagagtcctttcttctactcttagttttgctaaattgggcagtagaatgtttctgtttgttaatttgaaaaaaaaaaagataatagtctaacaactttttaggtttcttgtgcagtttatgtgacacaaggcatgaaaaacatttagcatataaacacatagcactaaataaatcagaggtgcagttactccagtaaacggaatctctcaaggcctatagagatgtattgtgtgattttctttttctgcctgcttttaagtttttttctgtagtgtccgtcaatgtcagcatgttagctaacaatgtgtttaatacttagcagatgctgtcttatcatcccttacttaaagtcccttaacggctccctaatgccttcattacaaaatctaaacacctcatgctgacacaaaacatacctgatgtcctggtcggcctctggctctcccttcccatctcccactgctatctcttatgtacctgcagccaaaacaaattacttacattctctgagcattctaccttct

SEQ ID NO: 452 - DNA, 59561 bp, Homo sapiens
tcgggttaagaaatacctttaaatttaggtaaataaagctcaaggaggtggggctgtcatctgtggtgtcagtccttctggccccctggctgtcagtgtcgctccagggccttgacaagcagctcattcaagcggcccaccatggccctagggtcgtcaacaagtccagcagcaatcatggcgttctcgtatatctgaaaggcaagaggagaaacccattatgaggggcatggggcaccttttcatttttttttttttgagacagagtctcactgttgccgaggctggagtgcagaggcacgatctcggctcactgcaacctcaggtgatccccccgcctcccaaagtgctgggattacaggcgtgagccaccacgcctggccatttttccgtttttaaaacagaatttggctgggcacggtggctcacgaggtcaggagattgagaccatcctggccaagatggtgaaaaccccatctctactaaaatacaaaattagccaggcgcatgcctgtagtcccagctactcgggaggctgaggcaggggaattgcttgaacccgggaggcagaggttgtagtgagccaagatcgcgccactgcactccagcctggcaacagagcaacactccatctcaaaaaacaaacaaacaaacaaaaagacaggattttagaggaaaccgctgttccaccctgaaggcaggctggcagggctggtagcctgggtccctgcagtcatcctaagctgctgcactcacctgatccaccagcagctgagccaggccaggctcgcttgcgcgcagctgattcagcttcttgatgagcgcgtgcctgcaacacagaacccaccagaaaaagcagctcagtaccacgtgctgtgaccctcccttcatgttttgggattatcaggatatttaaagaagcacagtaagactgtctgtagttttttaaataaggtatgttaatgatcatttatagataatatcattatatacccagaaaacccaagagaatcaggagtgtcagtattagaaaatgctgtaaggtagccaaactccaagattaatatacactaaagggacaaaaggagcttagtacgtgaagacatgccttggttcctagataaataataaaagagaagggagtaagacccacatgttgaaacatattatagggctctagtaaataaaacagtttaggtctggaaagggggaaggcaaacaactccatgtaacgagggtggacactgagtgtctgatgaggacagtatttcacagaagagggaggagacagatcactccatccagcagcactgggatgactgggagccatgcagaaaaccatttagaccagagtaaattccagagggatcaaagatgacaagcacaattctagggaagaaatgtttcatcatctcagaaggggaaagcctttccaagcaaaaccacaaaccaaaaagtaaagaatgattgacatatttgacgtcagaacaatatttttttctgcataggaaaaagcatcatgtagtatttaaccttaacatgaatattataatttttcacttagaagtctgataaaaccgagggctctggggaactgtaaatttgtacaacctctccagaggacaactggagtcgggaaaaccacatgtggatgatatgctgagactcagccattccatttcctaactgcatccctttaaacacttttttttttagatagatagatagatagatagatagatagactctcactccttcacccaagctagagtgaaatggcatgatcttggctcaccgcagcctcctggtttcaagaggttctcttgcctcagcctcccaagtaactgggattacaggcacccaccaccacccccagctagtttttgtatttttagtagagatgaggtctcgaactcctgacctcaagtgatccacccgcctaggcctcccaaaatgttgggattacaggcgtgaggcaccgcacccaacctaacagaggaaacacttcaaatgcacatcctcacatttctagtctacgtagctggaaaaaaaggacattcttaatatgctaatgtggaggtcacctagttaccctaagggagaaaagcaaggcaaggacccactgcacagcaagttcccccttggaagcccacgggcgcagctgcccacaaatgcacataatctctgcagaaatacaaaagccctaatgctggctgcactggggacacaggtaggaggaaattttcccctgtaagcagttttgaattctgaactatgtggacagaacaccaaattttaaaacaaatgaaagtgaagctggctgggcacagtggctctcgcctgtaatcccaccactttgggaggccaaggctgcagtgagctctgatggcgccactggtacactccagcctaggtgacagagcaagaccctgtctccaaaagtgaagtggcaacagacagaaacgagcacttctgcagctatctcacaaaactagtttgccaccaaaactagttaaagtgacctggtgtccgcctcactgagctgctccagcagaggcacaggcattctgcatactggcgctgctgtgcactgacagccataagccaagtcagcctttccccaggagtgccatggctaggaagatgcatctccctcgcctccagtataattttaaaagttatggttgtaaaatgacaaaagaaaaaaactagacatgtactaaagaacaaaacaaaaactggctgggggtggtagcccacacttgtaatcccagcacttcgggaggctaaggcaggtggattgtttgaggccaggaggtagaagttgcagtgagctgagattgccccactgcactccaacctgggggacagagtgagaccctgtctcaaaaattaaaatactacttaggctacattgtggggggggtggtaagtctatggattttgatttcctttttgctgttttctatttttggtaacatgtttatgtaacttcattttttaaaaaattgctacattcaaaatttcccccaaaaaagaaacttcatatacaagttagttcatatacaagttagaaaatgaaattttaaaataccccataagacacatcaaagaataattctttaaaaatggtaccagaaccctacagagaatgtaaggtaccaaaggatgttaaagacctaaatagatcacattcatgggtgcaaagaagtgatactgtaaaaagaaagaaactcaaaagatacctaaaggcaggtgaaaagacatttacaacagataaagggcatataaagaacaacaggaagaaacgagggaaatcttacggctcagccactgtcagggctggggggttctcggtgcaccctggaagcagctcccaccaccggggccacagagaaacccacacaagccccagacacgtggacaagaatactcagagcagcctggctctccacaacttctgaccaagaaccaccggaggcccagcagagcagaacggagcagtctgctgtgccgaggtgggtttctgcagcggacattattcggctatgaaaatgaacttgtggcagcccctctgcatgggcaaccctcatgccaagtgagcaacgtgagacttcagcaaacaccaagatccacgtacaaagctcaaaacaggcaaaactgagcatgtccaggacacgcacaggtggcaaagccataaagcaaaacgaggacatggtcacaggctgggatgtggctaacctcccaggtgacacctggggatggtaaggggctggccaggttccatttcacatgggtgcagcctaaactgcatacagctccttatagttacccacatgtccacaggcctcacgcacttttcttctgtgtcacattccacaacaaaagaacaccacacacaggattctggggaatcccacaggctggaagagccaggagcgtggcctcacctggggttgatctccagcgtgggctgcaggagctgtgcgcgctcctcctgggtcttggccagctgctgcatgcgcaggaagtggcgggcagcccccatctccagcacggtgaccatggcagggtgggtgtccagtcggagggtcacctgtgagcaaagcccggggttgagggtgatagaggttcccaatgtgagagggctggcaggatcttaccaggggtgaaggtcacccagaccacgaggtagcaggcggggtctcaaggactcccctggaccagcgctgctccctccccattacccactaacttgtgggccctgagctgatgccccacgcaaagatactgtgcccgaggggctccaccaccctggtgccccgctgctgcctccaggagctgcccgaatccatcgtcctctgctccatgccagcccaccctgcatgaggccccttcctccaagtgaccatgcatgggacgctcatttctcactctgagctagacaggttggtggggggagtcttagctctctgaagcccacccaaaacccccgactaagcacccaagtgagcatgtgagctcctgagggctggggtagcatgtcccttgtttggaacccccacgtcctcagccattgcagctcccactcaggatgctggtttttcagttctcagttcacacctgctctggagcagggctgggagaaagacacggccttcctgcctcagcggcactcccgagcaacacgtgccgagcagggacccacagggtctccacctgacaccaagggcttctgctgctgctggaaggacacccaacgggccaggtactgggagccaccagctggccagcctgttagggacactgcggccaagtggtggtccatccccgggaaagcctcaccttcacgttggtgacacgcgaccccagcacatttctcatccaggccatgagctcctccgtctccttctctgataggcactcggcggctgcggaagagcaggcgacagggagctcaggcctgcatcccaactccccggcttccatgggggccacgcagcatgcttccagctcccacctcctctcccaccaggatggagacacaagctagcaagatgcttttcatctaaaagtaaaacctcaaaggatgcttcaggttgcctgaggcccatacaacttggttagggctttaaaaaaatacacagcctctcaagaagctgggccagctccagaagccaccgtggcaggagcactggacagacccctgatatctaaaccaggaggcaccttcctccagtcaccagggtgctcccacaaggctcttctcgggggtggctgagcccaggtcaactgacgaaaacccaaaggaagccctcgctgcggggcaggagaggcgtgcggggagtggaaaccagccccacgcctagagagcaggggatgccgacctggggacctgtcctcaaacttctcctccttgtagtgatccacgactatgtccgtctccacagagatcagcttcttcttgtcaaactcacgaaggtgcagcagggtgagctcatcaaactgctcaaagcagaagagaacctgcaggtggccaagagcagctccatcagaccccgggggcctccagccaccacagaagaaaggatgagggcggcaggagggctgggggagccaagcgggccacactggggaacaccggggcagttggggttcctaggcctgcatgacagttactacgacacctgggtctaaggaaggctctgactgccttcaaggcagaagcactccacgcataaagaaatccacatgtggctgagtgcagtggctcacgcctgtaatcccagcactttgggaggccaaagcaggcagatcatgaggtcaggagttcgagaccaacatggtgaaatgccgtctctattaaaaatacaaaaatttgctgggtgtggtggtgtgcacctgtagtcccagctactcaggaggctgaggcaggagaatgacctgaacccaggaggcggaagttgcagtgagccgagatcgcaccactgcactctagcctgggcgagagagcaagactccatctcaaaaaaacaaaaaacaaacaaaaaaaaccacatgtgacctccaagtgggaaacagccgtcacagtcggtccggcctctgtgcccgtgaccctgacccactgtgcagccctgcccggagtcttgggcaggttcacccagcacagagctgagaaggtcaagaccctccccaggttgcagcccccggagcccgccccacccaccgctcacccacctctgtgtctttcttcttcatggcctcatagtagggtgagtgctctgccaggtgacggttgggggcgcacaggtagtagatgttgcgggtgccggcccgcatgcggctggcgtattctgagaggctggttagctgcccggagggcagcgccgaggactcgtagcgcagcagctttgctatgtcctcctagaagggacggggcaggtcaccacttattccaggcccatgggctcaatgttgcccaactaactgggcgcaaaccctccgatgcccatggcctcctggcactccaggctggccctgacccgagggacggtagtggactcgggggttgtccgagagcaggccttgctctgcccatcaggccccttttgggagctctgggggcttaggaagcacctcctgccccaggtggcccaggggctctccagggagctacgcgcaccacgccctgggaggggaccccacccaacagcagagcccggcctggacccagcgtcttccctctgccctcagtgacagagtcagtctctggtgggcacacggacacgggtgaagtccacggttcccggccctcctcacagctggctatggcagagactggctttgcccagtgggtttcagtgggatttggagaagggcccttaggggaggggtttgccctcctccccatcagctgaacgcagctgtgacctctagagctcatgggagctgcagctggaaggacgcagggggaaaacagaaagagggaaaagcaaggagctggacacccaaccagcagggcccaggccacccctgcacacatggtgggtctgcattgataagacatgtcacacgtgcacacctacaaagacctagaaatgtctctgactcttacctgtgtgctgttaactcaaatgaagataaaggagaatgaagaggcctgtgtcagaagctgccgaagtcggcaaacaaccagaacacggcctccttgggaccccacacacgtggtcaccctcctcctgctgctggggagaagggacaccagcacgggatgggctcctgggatgaaatgttctggggttacagtggaggcagccacaccacactgtgaatgcactaaatgccactgaattttacgtgttaaaaggtgaattctgtgaatctgatgctatgtaagttgtatctcaataaaaaatggacaaaaaatgtttatggaacaaatgtttcgtttttcagccatccactattggattaactgaacgactggcccctgtagcatagtatttggagactgatatccagtacatgatgaatagtccctcaacagacactgagaccacccacttccccacccacgggatcggagtccttggcttgtcccacctgtctgtggctccccagcccccaacatcctctgaggggagacagtgtgtgcacgccctcttcctgccactccctgggctgcaccttcacacagcagtgaggctgagcccttcagagcacagcacagcactggtgggagggtaaggatgtgcctggaaggtgccagaggcccagaagcctggccttccatttcctgaccctggtggcagcagcagcagcagccagggtacccagctgcaccgtcgccacatcaggggacacctccaccagcttcctcagcagccccagggacaaggtggcccagaaaaaggcctggaacacagctcctataccttgacctcctgctcggtggcggtcacaatgccctcccgcatgaacaggccgtaatcttcaaaaaactttgcatacttctcagcatcttttttactctggtcaatgaagaatttgatcagcctctgctgtaaaacgtcccggagtttcctacagaaaagaaatgcatttaatacatacaagcagcctctatgaaatacaaatggccagagggtacgaaaaaatgttcagccccgctaagaatcaaagaagtgaaaacaacaaggtaccgttattggccaaactgaaaaagactgagcagaaagacagaaaccctgggcagtggccggacaggaggcagcagggtggagggcagacaccccctggaggcagtaggagaaccgatgcccccagagacaagatacccacgcccggaaaacccttccaacctttgagccagttgttccaattataggaactgcaccttaggaaacatgtgagcacaccaagatttatgtaccaggattttcactgtggcacataaaatataacaattatgaacaacctcatgttcaagaatataggctaaaattatgtaatgctaaatggccataaaaaaaaaaaactgcatcttttaataatcctcaatgacatgagaaagttagctgtgttgaaagaaaacccagaaaaatcccaatgtgggtaaattacagtacgtctatagatacaggcaaagaatgcacattctacatgtacataacaattttccatcattaggagcagcactgtatatactatatatgtacactgtaatttgggatttatactgaatatatgtatactctaatttttcaaaattgggattttagggatcaggatatttactgcagcattacataatggcctaaaattaggaacaactttatcactgggactagggatatttttattttcttcttaatatttagtctttcctttaagcaggtaaattacaatgtatttcaataatccagagcatgggaacaacactctctcgagttcatttagagcctttcctcccacactccatccccagtgactcagtccttcagccacagggcagaatgggacaggacatgccttcgtgcctgggagcggggggacagtagcccaggatgcggtgcagagcccagggaaggtgtctatgcagggccatggttgggaagagcctggtatgggtgtcagagcccaagaaccccagagaagggtgtccaggctgggggcgtgaccagcccaccgtgaagagtcagagcccaagtaggtgacagggacacccgcagaagagggcagtggcaatggtagattggttacatggagggggattggtcaaatgggtaaccgtgctaagaataatcaacggggcatggtggctcctgcctgtaatcgcaccactttgggaggctgaggcgggcggatcaccagaggtcaggagtttgagaccagcctggtcaacatggtaagcccccgtctctactaaaaatacaaaaaattaccagggcatggtggtgggtgactgtagtcccagctacttgaaaggctgaggcaggagaatcgcttgaatccgggaggcagaggtttcggtgagccaatacctcgccactgcactccagcctgagcaacagagtaagactccatctcaaaaataaataaataaataaataaataaaaataaaaaaattttattaatgatagcaagattataaactcttgaataaaacaggaaatcagcccatataaataaattataaatagtataaatataacacatcaatttttttttttttttccatccgacgaatcttgctcttgtcccccaggctggagtgcagtggcgtgatctcggctcactgcaacctctgcctcccgggttcaagcaattctcctgcctcagcctcccaagtagctgggattacaggcacctgccaccatacccggctgattttttttttttttttttttttgagatgagtctcgctctgtcgcccaggctggagtgcagtggcgtgattttggcgcactgcaatctccacctcccaggttcaagcaattctctgcctcagcctcccgagtggctgggattacacctgcctgccaccacgactggctaaaattttgtgtttttagtagagatggggtttcaccatcttggcaggctggtaactcctgacctcgtgatccacccgcctcggcctcccaaagtgctgggattacaggagtgagccattgcgcccagcctaatttttctattttttaagtagagacggggttttaccatgttggctaggctggtctcgaactcctgacctcaggtgatctgcctgcctcggcctcccaaagtgctgggattacaggcgtgagccaccgcgcccggccaacacataaatattttaagtaaataaatgaatgtattgagagtttcatgaagaatgtgacatttacatagcttcaaaatacctataacatctgttaattacaaagggaaggacatccttgtttgttggaaatgcaccccaaaggcatcgagaaggcaacttcctctcacaggattcgaggaaaaacatgttcttggtaccatgcttccaacttttaagcctgtgattctttcaaaagctctaatttcggctgactcttttctgatcgagatgagttctcagactgacaacgcaacctttgacaaccacaagctgggatgaggacccctgctctgcagcttcgggcactaccagtgggccagcatgcctgccacagccaggaatgcagctcccttactgagcaggaccacccctctgtgactcagtttccacaactatgagtgaggactcacggctcccctcacaggatgaaacacgtgtttatgcaggctcagcacagttctcagtggagaagaaatactcaggaaacacattcaggatggggagaggaacgcagccgcctcggcccgcagggacgccaggagctccctctccacagggcctggcccctgcctccacttcatccgtgagcttcccagatgaggccagacgtgtcctcagttcagtgggtgtcctttgccttatccagcccagggacattgtacctggaacctcccctcctgtggccactcctgggcagggtgatggggatggacaaggtggggacaactccagcaccagcaataataatccgggagtcagccccaagccctctcttcactgaagtgaactgaaacattgggcagatcaccagtaacccacaggcgcactcgaagtgcacagggtcagtacaccaaagagcacgactctaacgaccacagaacagtcgctgctgtggggcggggatgcatcctgttgaggtcagcacaactgctgccctgtggtcatgtcggcagcaagtcggggtcctgctgtcagaagccagcacggctgtgtggggaaacaagcactgaggcccccttttcattgattatataacatctctttagtcagcaaggaaaataccttttatatagttatatcttccgaccaagtaaccccacccctagtattctatcctaaggaaatacagctgcaggtaaagatttcagaacaggccaggcgcggtggctcacacctgtaatcccagaactttgggaggccgaggcaggcagatcacaaggtcaggagatcaagaccatcccggctaacacagtgaaaccctgtctctactaaatatacaaaaaattagctgggcgtggtggtgggtgcctgtatcccagctactcgggaggctgagacaggagaatggcatgaacccgggaggcggagcttgcagtgagccgagatcgtgccactgcactccagcctgggcaacagaccaagactccgtctcaaaaaaaaaaaaaaaaaaaaaaaaaaaagatttcagaacaaagataaacatgcactgcagtgtcataactgcagaaacactgagacagcccagctgtgcagccccgagggacgggatcagtaaactatggtacatccctgtgatgtcccatgatgtagcaattaaaagtgcttccaaaaaacaacatgggaagtggtgcaaataaactaggtagaaaaaaggaaacagtataagcaatatgaattcaattgcatgaaaaacaaaaacaggccgggcgcagtggctcaaacccgtaatcccagcactttgggaggccaaggcaggcggatcacgaagtcaggagatcgagaccatcctggctaacacggtgaaaccctgtctctactaaagatataaaaaatcagccgggcatggtggcaggcacctgtagtcccagctgagacgggaggctgagacaggagaatggcgtgaacctaggaggcgaaggttgcagtgagccgagactgcgccactgcactccagcctgggcgacagagcaagactccgtctcaaaaaaaaaaaaaaaaaaaaaaaaaaaaatctaagtggccaggtgcagtggctcatgcctggaatcccagcactttgggaggctgaggccaaaggatcgcttgagcccaggagttcaagatcagcctgggcaacatagtgagatcccaactctacaaaaaaatacaaaaaaattagccaggcatggtagctcacacttgtagtcccagctacttgggaggctgaggtggaaggattgcttgagcccaagaggttgaggctgcagtgagctgtgatcacaccactgcattccaacctggacaacaagaaagaccctatcagtcaaccaataaaacatcactgcggcttgcttggttgaaaaaagaaaaaaatctccatggctttctgcctctgaaggtgaggcaggaggatatcaccggcaggccatgtgacctcgcagggctgggcatggacccaccaggcaggaaaccacactgcccaccatctccccagacctgctcctgcccgcggcacaggacagaatctctgaggaccagtgcctctcggtgtgggcctctcgccatgcccacagcgcagccccaacacacaccaattacccagactcatcctttttccgaggatctgcttccatttcaacactggagagaaaccggtgggcagagaaacactgcaggcacgttgggggctccaacaaggcccgttccatggcatgctgcacgtggtgggctcttgagagacctccagggctccaaattccagctgaatcctcaccccacaggctccctctgaaacctgccctatgtggctgccaatctaccccaccctaaaccatcaacagcagtcatctctaggtgagagcacaggtcacttgaatgtgctctagtaaggaaatactacttgcattaggggaaaaaaagccagtaagcgaggttttgaataaagactatttggtgagcctggggccagagtggggaagtgatagctactgatggagaacctggagccagcacactggagtcccctccacacagggctggcctgctgcagggctgcagtcacaaccctggggcacaggtgggcaggtctggctctgcggcccctccccctatccagactccagcctcagccatgaccagccacccccaccttcttctggaccacaagcttcagaggccaggccagcacctggaaggctcctgagggcccccatgtgcaggccgggcttccccgaccacctctgctctcagctccatgggccacggctagggccctctgggggcaaaggagcaggtaggggccttgtccccagcagggtcctctccccgcggcccgaggctcacctgatgagtgcgctctcctgcagcagctcccggctgaggttcaggggaatgtcctcactgtccaccacacctgggagacacggcagtcagcttctcccggggctgcggccctccacaccacccaacattccccattaacctgccctttgtcttcaggcctggccttcaacccagcacgtgtgctaagagggaagcagggaggcggcactgccggagcttcctctacgtcctgccacctcccagaacagtgacctgggctgtgggtggccgggacagcctcggggtaacactcggaaaatgacagcctgggctttatgttaaaaatcacaactctggctgggcacagtgtctgacgcctgtaatcccagcgctttgggaggccgaggtgggcggatcatgaggtcaggagttcgagaccagcccggcaattatggtgaaaccccatctctactaaaaatacaaaaattagccgggtgtggtggcgggcgcctgtaatcccagctactcgggaggctaaggcaggagaatcacttaaggaggttgcagtgagccacgattgcaccaccgcactccagcctgggtgacagagcaagactcgtctcaaaaaacaaacaaacaaaactctatcagggatggttcgcacctctgtgtaccaaggcttaaatactgaagtctttcttaaactataatctcactcaaacgtaacacaactcacatatcaatctgaaactcagtatccctacatatggaaagacctcaatctgaacaccccagtgctccccccagatcagtcatgtgcgtagggaggtggggcagctcccggggtctgtaaacgcgactgacacacaggcagcgcaggccgacggcggtgctctcgctgcagagggctgctgagaatggaatcagcacggtccctcacagatgcagcgggcgacactgggccacgggggcactgctcacggactctgagcagcgtacctcggatgaagcgcagccacttgggcaggatgtccgtggccttggtctggatgaggactttgcggctgtacagtgcaacgctggagcccagctcccggctcacatcaaacatggacggtttctgggggtgaggagaacacgccatcatgcagcactgaccctccccaggcaggccctggctgggaggtgggggcggacacgatgaatccagagcccactcccgcctcgccctcccccagcgtctgctctgagttgaagcccagtgcaggggccccacgatgccccacactgtggctctgcaggggctgaaggccttctctggcagctgccgccctccccagcccaccccctaaggaggacacaagagagtgaaccttgcacgtacccctgaacacactgaacacagccaaaccttgctacaggtcagggatcagcaaagagccctccgaccagatccagctcactgcctacctctgtgtagcctaagagtggtttttacactttcaaacagttgaggaaagatttcaaaaaggatgatctcatgagacgtgaagatgaaactcaaatttcagtgtctacgcagctcatgggacccggccctgtgtgctcagagggcagcagggcagtgctgcttcctcacccggcagggttagtggctacgaaagacaccgggcccgaaacgctgggaccagctcctgtctggccctcgtggaacgtgcctgccaacacctgctccacactggtacttcccgaaccgggacccacacctcatcacgggatctggttaaaatgcggcgggtatctagttcaaatgttgggagacctggttaaaatgtggggcgacctggttaaaatgggggggatccggttaaaatgcggggagatcttattaaaatgtgggctcccacgcaggagccctgggtggggcctgagactctaacaagcccctggaggccacacctggctggctctttccaagatggatgccagctgtgcaggacattaggagagtttccaggcagccaaggacagaagagcctgggggcaggacgggctggctctcagccccgaataggtctccttacggcaggatttgcgggaacttcaatgtggtaaaggaaaccaggggaggtggagggtgtggaggaagcacacagagaggccaacggagaggcaagaccacaggcccttcccagagcgcctggcaggacagcatccactgatccacagcagatgatgtaggctctgagggccctccccaggcacaccccagtccacaagcctccaccccagcctgcactgagatgcccatcaatccttccctcgccatgtgtgacccctgagacagaggaaacctctgtggttacccacccagaggcatctgttctttttttcttttttttcagagatggggtctcactatgttggccagcctggtctgcaactcctgggctcaggtgatccaccctcctcagcctcccaaagtgctgggataacaggcgtgagccaccacacccagcactacctatgtttttcatgccctcacactgccatgttaatcatgtgacatctgcagagctgatgccacaggggacaacagagtcaccctgagggccgtgggactgccacagtgcctcaccatgtcgggcacgtagaagatgctgcggatgttgagcggtgcgtccgtcttatagtgcagggtgtagcggggcttgtcgtgagcctgcgcgacgtagcggtagaactcctcatgttgccactcacggacatccttggggtccatcatccagatggcctggaaacggagatcggcggggagggcgtcgtgttcaccacgcacgtcttctccaccaccgtgcaggcctgagccagtgcagcgcctggccctggacaggctcctgggacagacgggcggtggtctcaggcgtagacccctctccagccccaccgctgggctatgccgggtagtgcaggggagacacacaaggctctggggcaggagctcctcaggacaacatgtcaggaggaccagccgggacctgagggggcctgtgggagaggatgacgctgcccagcaggggcgagctgacgaatacagtgtgggccgtgagagcgatgacgacccacgctgcaccgcagctgagccgcgagggggaagtcagtcactgaggacagcatgccgtgtgactccatccaggagaaacgtctggaacaggcagcacaatggacagaaaggagaccgtggctgctgggactgggggaggggcagtggggaaagggctgctttttggggtgatgggatgttctggaattgatgcggggtggctgcacagctctgtggctgcactgaacaccatggctgcacactgatgtggtgagccagctgggatgggcgttacgcctcagtgaaccctgacccctgaccccggctgcccggtgcacaggggcagggctgtggtagagctgggcccctgtctcatccccacacccaggtctcatctccacagagcagctcgccctgtgactctgggccgcatcccctgggctcatctcttctccgctgccctgaaacgtacagatttgtctccatgtttgaccagtccctagaggaactcagggctcacctgcaaggtgttcatccgccttccattcaagtacaaggggaagctgacgaagttgctgtacttcgttaccacatctggaagggacaaaagaaaaaccacactgcatctacaatgcttgtggaaacgcaagctttgcagcagctccaggatgagcgccagcctgctgggaagggtcctccatgctgtgtacacttcacaggtacagaaacagggcacagtggggacacctgtcctccccccagtctcacgggggcagcagcggagcccacgtgagaaccagagctgtggaggccccggctgctgcgagactgcaatgtcagcttgtggctggaacatggctttctgggctgactcctgggggtactcagggcctccctgagtgtccagcaggacacaaagagggaaggccacgcccacatcctgggacaggactgcgccaaacccccaggtgcactaaaggccaagggccacgcagaggaaggaggaggaggtccgcctcagccaggccagcttcctcccagtcccagcaggagctcgatgctacgcagccctggcgggcagcccccctcccagtcccgcagcggctcggcccttcacggctctgcctgtgcaccctacgtgcaggtagaaccagggaaaatgcctgctgacctggtggcctccaggccacacatggatcccagagtgagcctgggcccgggctcccgctcacctcgcacccgggcctcgctggaaaactccttgcagtcggatttcaggtggatgatgatttttgtcccggttctaactcccgaagcttcggcgatttcaaacactccagaactaaggcaggcaaagaaaggaaaagccaggtggatgtgacactgggacataccctgcatgggactccagcggttcccgagggtttcataggcagagcccaaacaacacacaacacacctcaaatgccccatttctgaccccagcgcaccactcaggccatcacatgcccatcaggaacgatgagcctgtcgcaggcggcagagttctcctggttccctcgggcggggggcgggggggcgggggtcctccaccgaccctgggcttcgaagaagcttctgggcttaccccaaaagcaggcctggggcactgtgggggactggcccagctccaaatcgggtgccagatgcccaggggcaaaaacaaaggccagggggacaggcgccccctaagaagagcagaaaaccatctccgaagcacaggaggggggaatcccccggcagggccatgttgatgccttggcctaagtttactctgagccccgctcccatggaattaaacaggaatgttagttttgggagagtggggagtcaagctgagcacagtgcacacactgtggagcagaaatggcatcacggagggaggacgcctcggctggctggaagcggctcacctgctaaaaagccctcggagccaggcgtggtggctcacgtctataatcccagcactttgggaggccaagacgggcagatcacctgaggtcggggttcgagaccagtctgaccaacatggagaaaccctgtctctactaaaaatacaaaattagctgggcgtggtggcatgcgcctgtagtcccagctactcaggaggctgaggcaggccaattgcttgaacctgggaggcggaggtggcagtgagccaagattgtgccattgcactccagcctaggcaacaagagtaaaactccgtcccaaaggaaaaaaaaaaaaaaaaagcccccagcaggctcctcaccctatagaggcagaagtgggctggggagacaaagccaggaaatgccagggctgggaggaagcagaatgagctcttgcagaaggtcggtcacaggaggctgcatagtgtccaccaggcgacaggccagtcctgcagctcagccactgagaaaggagctcagcgcgggccggacctgccttcccgagcgcagtggtggtgaccaaccacatgggaccagacaggtgccataggccacctggagccacaaaagtcactaactccccaaaatgggagagtcagatttcatataaaaagcccagaaaatgcctgtgtacgttttctgagtccatccctttccaaactccatgctaagggctccagctcagctttgagctgcctgtcaggcgacattcgtcactcacccatctgaaagccactggtaacccaggctccccggggctgccgagcgggaatagacctccactctgtcagccaccatgaaagctgagtagaaacccactccaaactggccgatgatcttgctgctggcctcagcctggttctgcagagcatccaggaaggcctgtggggcagaggccagttagtgaggcagcctcccctccagagagcagacactcccaacaccgtggctcttctgcgagcaccgctaagaccccttcatcctgaaaacagccacaccgagtacttttccaccccattctacacgtgaagagctaagtcacagagaggtgacacattagccctaggacaaccagctggcagcagtgggacaagtgtgttttccatttgattcccaaagctcacagtcctgcctgtcccagacaggtggaggcctgtgggtcacacctgggggtggggaaagagcagcttgaataagctctttcccttgaataagctccttccataggaaggccaggagtgaggagaggctccaaactggcttccatattcaagtctcctggactctacactttgtgggaaaaagagtagaaatcacgcgcatgcgtctgtaagcaccgcacagcacttcatttttctactataatactgccaaaggtcctaaggccaaagtcaagtaaaatacacacgcccactgccctggcccacgttgtccgatggaactttctccaacaacaggaacgttctgccaggtgcaatgcgacagcctgccgagcacctgcaatgtggcctgtgcagctgaggagcacaatgtccccttttatttaatttgaatgcatttacatttaaactgccacatgcagctggtggccgctacacaggacagcagaccaacctcgagagaaatacaacaaaagacgtaacgtgggggtcaagtcacagttagggtgggttttttgtttgttgttgttgttgttgttgtttttgagatggagtgtcgctctgtcgcgcaggctggagcgcggtggcgtgatctcagctcactgcaacctctgcctcccgggttcaagtgattctcccgcctcagcctcccgagtagctgggatgacaggtaccaccaccacgcccagctaatttttgtatttttagtagagacggggtttcaccgtgttagccaggatggtctccatctcctgacctcgtgatccacctgcctcggcctcccaaagtactggggttacaggcgtgagccaccgcacccgacctagtgttttcatcttacagatgaggagactgaagtaagtgctttgcccagagctggaaaagggcgaccgctggaggttcccaggctgttggtctgagtccaaatgtgttgctctgcctcacagcacttttctgcaaagtcgattccctgagccttgtgggcttgacgcagagagggtcagagggatcagtcccctctcacacagcgccgtgatgagaacgggcttgggatgcggcgtctgtgggtttgatggttctggtcagaactgctctgtgggtctgggcatagtgacgtgcacctgtagtcacgcctcaggaggctgaggctggaggatagcccggccaacatggtgaaaccccgtctctactaaagatacaaaaaattggccaggcgtggtggctcgtgcctgtaatcccagctacttgggaggctgaggcaggagagttgcttgaaccgggaggcagaggttgcagtgagccaatacagttggtcctcctatctacgggttccacatttgcagattcaaccagccaaggatcgaaaatactcagaaaaaaaataaaaaacaacacaatgataaaaagtagtataaaaaacataactatgttatatctatatctagcatttacattctatcaggtattataactaacctagagaccatctaaagcatacaagaagatgtgtctacaatatacggcaccaatttaatccgggactggagcatctgcagactttgctatccaaggggggtcctgaaaccaacccctagatactgagggaccaacccccagatactgagggatggctgtcatgtcatgaggtgttcccacagtacccactgcgtggcatgcaactgacaacgttcttacttaatctggcacccagggccacccctactggagggatccttgcaccctgaggggaagggggaggctgtgtgggggccccacgcttacctttgaccccgatctggcaatcgtccccaggttggacaccagctcttcctgtgtcatcccgataccagtatcctgaggagagagacgcactaagtgccaagcccccagcacctggggagccgggtgagtgcaccagcagtcccagggactcaagtggtgtcaatgacattggccagacagggcccagccaggtagcaccagatgctcatcagaaaagactaattctaggggccgggagtgatggttcatgcctgtaatcccagcactatgggaggccaaggcaggcggatcacttgaggccaggagttcaagaccagcctggccaacatggtaaaaccccatctctactaaaaaagaaattagccaggcatgatggcgagcacctgtggttccagctactcggaggctgaggcaggaaaattgcttgagcccagtgaacccaggaggcagagactgcagtgaactgagattgcgccactgcactccagcctgggtgacagagtgagactccatctcaaaaaaaaaaaaagaaaaaacgaaaagactaattctagtcatagcagcttggcctcaccagagaaaacaggaagggacagcagaaagttgctttgtttgttaaaaaccattccgaaaagaaaatattacaccagcaattaggaaaagcacagctctcccaccatcaagatgtggcccccacgccttctccctggctgtggttctggggaacagtgatcccctctggtggctctctcaatccagcagaatgatctgactgaggacaccaggaagcaggtgttgggaacgcagctctgcacgcggcacctactcccaccctaccaccatgggaacagcgggcacagacgcctctcctgcgggaaggcagagcccttgcgttggagcctctatctggcctatcctgttgcagctgctctgctctgagtgccagtgtcacccaaatccatatattaagacctaagtcccaaggggatggcactgggaggggggccttggggaggtgatcaagtcacgacggctccactctcatgaatgggagtagggcccttagaaaacaggcttgagggagcttgcctgccccttccaccttctgtatgaagatgcaagaggcactgcctgagtcaaagggccctcgccagatgcccaatctgctggccccttgctcttggacctcccagcctctagaactgtaagcaatagggttctgttgtttataaattgcccagtctaaggtattcggctatagcagcctgaatcacaatacagaccaacgcgctggtgaacacacaaggccttactgaccatgggctcctccttcctcaaagcccagtcagactcccatctgcagatcctcgctcaacatgcccataatgtagccacagccccagcttgctctgctatgatgtgcagaccaccttaaataaaagagctcactccaagcctccacatctatgaattgggacaaaggccctcagaaacagttttctgaacttccttctaggaagttcctttctaaagacttcctctccaggacagcctgcaggagccatgggagcccactagcaccaggcgccagtgctgtctccattggcaaagcaagggtggtcagtgccactcagcaaataatccacagcaagcagcaggccagggagactggccagctgtcagccttcccattgtaggcagcacaggcagaatgggtgccaaaaccacatcaccaccagttactgcagtgcacacatgtgtgcatgtttcacgggccccagcagccaacaagaaacatggcaccaagaggcttctgggcaattatttctgaggtgccggtttgaatagtccaaaatccagcctgattcatttattgtagatcatgtaataattatgaataaaaaactacttaaaattagtatctagttgatatcagtcattaaatataagtttcatttaagtgtttaatacatcagaaacttaaatagagtccttaagggaaaggttaatgttagaccaaggtaaaggaaaaaatgcaactaatagctcctattttcaatttatttttattttttcccaaactgatctgcactgcaatcccagtctaaatcctcacaggttttgtagaaaatgacaagccgattctaaaatgtatatggaaatacaaagaacttagaaaattttcaaaatattttgaagaacgaagttggagaatttaaaatacctaattttaagacttcctataaagctacaataattaagacagtgcgatgtgggcatttaaggatcgacacatggatgaaagaaccaaacagagcacaggaacagagatgcacagagagtgtattacttgatttttgacaaagattccaaggtaattcaatgggggatgataggtctattaacagatagtactgaaacaactgtacacccataaacaaaacataaacctcaagccctacctcacaccatacacaaaaattaacttgaaatggatcatagatctaaatataagagctaaagctataaaacctctagaagaaaacatagggctggacacaacagctcacatctgtaatcccagcactttggaaggtcaaggtgggaaaattgcttgagcccaggagtttgacaccagcctgggccacaaagcaagaccctgcctctacaaaaaaaaaaaaaaaaaaatttctcgctctgtcacgcaggctagagtgctggagtgcagtggtgtgatctccgctcactgcaccttccgcctcccgagttcaagcaattctcctgcctcagcctcccgagtagctgggactaccggcacacgctgccacacccagctaatttcttttgtattttcagcagagacagggtttcaccacgttgcccaggctggtcttgaactcctgagctcagacaatctgcccgccacggcctcccaaagtgctaggattacaggcgtgagccaccatgcctggcaaaaaaaataatttttttaaagttagccaggcatggtggcatgtgcctgtggccctagctacagggggctgatgtggtagatcacttgagcccaggaggtcaaggctgcagcgaaccctgatagcaccaatgcaccccaacctggagacggaagaagatcctgactctaaacaaacataaaaaccttccaggtcaggctgggtgcggtagctcatgcctataatcccagcactttgggaggccgaggcaggcagatcacacgaggccgggagtttaagatcagcctgaccgacatggagaaactctgtctctattaaaaatacaaaattagccaggcatggtggcacatacctgtaatcccagctactcgagagactgaaggcaagagaattgcttgaacccgggaggcggaggttgcagtgagctgaaatcacaccactgcactccagcgtgggcaacaagagcaaaaccccatttcaaaaaaaaaaatcttcccggtcatcaaaaacaaggaaagtctgagaaactgtcacagccaagaggagctaaggggccaggacaactaaatgtcatgtgggatgctgggagagaaaaaggacatgaggtaaaaactaaggaaacctgaatagacttgtgttaagaataatatatccataccggttgattaactgtaaccaatgtaatatactaacatttctttttttttttttttgagacgagtttcactcttgttgcccaagctagagtgcaatggcgcgatctcagctcaccacaacctccgcctcccgggttcaagcaattctcctgcctcagcctcctgagcagctgggattacaggtgcacaccaccacatctggctaatttttgtatttttattagagatggggtttcaccgtgctggccaggctggtcttgaactcctgacctcaggtgatccgcccaccttggcctctcaaagtgctgggattacaagcgtgagccactgcacccggccataaggtttcaatcataagggaagctgggtgttggagtagatggcaacgctgtactatctttaaaatttttctgaaaattgaaatctgttctaaaatatttactaaaaaaaaaaaaaaactatagatttttcagatgtagacagaaatcatctgttgccaggcgacccgcacaatgtgattttaaaaggaaatggtgagactaggcgcggtggctcccgcctgtaatcccagcactttgggaggccaaggcagtcagatcacttgaggtcaggagtttgagaccagcctgaccaacatggtgaaaccccatctctactaaaaatacaaaaattagccgggtgtggtggcatgtgcctgtaaacccagctacttggggggctgaggcaggagaatcacttaaatccggggggcagaggcctcactgcagtgaggtgagatcataccactgcactccagcctaggcaataaaatgagactctgtctcaaacaaaaataaaaaggaatttgtgagggtttacaacaggtatatacataaaatatttgacatcaaaagaaaaagatgattttgccaccggaatgatactgttgtaagattcttacaatgaagtgttaaatatcaattcaagctagacagtgataaattaaggctgcatattttattccctagaaaatcccctaaaaataacaaaaagcaatgtagctgagatatcagtagatgagatggaatggcataatacctctgagaccccacaagaaagcttccttttctaaaactttaggtaagaataatctatcaatattagttaattaattgtaataaatgggctgggtatggtggctcatgcctgtaatctaacacttgggaggccaaggcgggcagatcacttgagggcaggagttcaagcccagcctggccaacgtggtgaaaccccatctctactaaaaatacaaaaattagttgggcatcatggcacacatccgtaatcccagctactcaggaagctgaggcacgagagttgcttggacctgggaggcggaggctgcagtgagctgagatcacactactgcactccagcctgggcgacacagccacactctgtctccaaaaaaaaggaaaaaagatgaaacaaatggaccatgacgctcccatcggctattgagaatagaaaaactgggtcccaaaggatataatggagctctaaattacctgctcaaattttctgtaaatctagaactgttctttaagaaaaaagaagacaaaagacaaaaccaaaaatcattattgtaacataaatggtcttagtaccaggaagtactggcacatgaggactggcccctctgctaaagaccaagaatcatgtccccatgaccccttgccccagcacatccattttcaatcatctgcaaggaacctctgtgctgaaaacaggaggaaagcacagggcgctgcagccctgcccacagggcccattccacagccaggccagctcagcaaaggcagggagagaagaaacccactccccacccaatccttatgaccaagggctatgacaaacagctggcacgtaccacggggctcagtctggattctctaaacccaagagggagtgcgtaaagctgacacctcacaaaagcccctcctttaattaaaacagccatcccttcacaagtccattcattcacgcgtgcctgcattcatttatgtggcatgaccttcagagcaagccagcaccctaaaagggaatactcagatcccaccgaggccagtctgtccacctctccacagagacagacacccccgcaatgacgccgtgaccctgggatgacaggtcctgaggcagctgtctttggatgcaatgtctctcagggcccctacctgatcctctttggcctaacttttcagccttaaaatttccacaaggctacagcagcagccacagcactgcttcgtcggcattttgaggggaaaacgcagttaaaaatatgaaaagagtacattaaaaataagatatgtttagatatgttaatacctgcatataccaaaaccctgtgtggccatatgctaagatgttaccagtagttattgctggatgatggggtgatttcaaattttcttcttttctgcttacctgcttttccaaaattttctataatgaatgagtgctactgtaacactaaattatagccagagttatcctggtggtacggacggccagtacgtccctgggacccgagacatcactagaaggcggatcctgtccttgctgcatggccgggcctgccacacgcctggacactgagggaggtacctggatggtgatggtgcctttctcggcattggtctgcaagtgaatctccatttctggcagtgcttggccgtcagacaccagtttgtgacgcagtttttccaaggcatcgctggcattggagatcagctcccgtataaacacctacaggaatagaaatgggaggcacagacaatgaaggacactcatcctgcaggatctatctggtcagctgcacttccaataactgttaaaaggtagaggagaatagtcaattctcaaagcataaagagtttctgctttagtcaaaggcagttcctctgggccggtcacaaagtgactgaaggtgctgactttcctttcaggatttctttgagagtctcactctgtcactcaggctggaggctgcaatcacggcttattgcagctttaacctcctggacccaagcaatcctcccacctcagcctcctaagtagctgggcccacaggcatgcaccacacccagctaattgttttaaaatttttatagacacagggtctcgctatgttgcccaggctggtcttgatctcccaggctcaagtgatcgttgtgcctccgcctcccaaagtgttgggattacagacgtgagccacggtgcctggcccttttcaggatttttaatcaagcctgaagttacgtgtccatctgttaattataactttaagaagagccctctggctggggttgggggctcatgcttgtaatccaggcactttgggaggctgaagcaggtggatcacttgaggtcaggagctcaagaccagcatggccaacatggcaaaacccagtctctactaaaaatattaaaattagctgggcgtgatggaacacacctgtaatcccagctactcaggaggctgaggcaggagaatcgcttcaacccacaaggcggaggttgcagtgagccgagatggcaccactgcactccagccccgacagagagagactctgtctcaaaaaaacaaacaaaagaggcctgcgaggaacaatttctttcccaactcctgcacagggatgacggcatatcactcaaacatccatttctccttgatatggtttggctgtgtccccacgaaaatctcaccttgaattgtactcccataattcccacgtgttgtgggaaggacctggtgggagataagtgaatcatgggggccgtttccccagtactgttctcgtggtagtgagtaagtctcatgagatctgacagttttttggggtttctgcttttgtgtcttgctcattctctctttgcctgctgtcatccatgtaagacgggacttgttcctccttgccttccaccatgactgtgagacttccccagccacatggaggtgtaagtccaattaaagctccttctttggtaaattgcccagtctcaggtatgtctttatcagcaacgtgaaaatggactaatacactcctactccacaaaaacaggttccctagcttcatctcatctagtggggaccaccaaacaccaggtctaccacacccggagaaaaacaggcctcagggcccagctgtccctcaggagctgaaaagcacactgacctcaaacagaccttccatttaaaatcagtgagagaggccgggtgtggtggctcacacctgtgatctcagcactttgggaggctgaaacaggcagatcacctcagcccaggagttcaagaccagcctgggcaacacggcaaaactccgtctctacaaaaaaatacaaatatcagccagaggctgaggaggaaggatggcttgagctcaggaggcggaggttgcagcgagccgagatcataccactgcactccagcctgggcgtcagacccagaccctgttccaaaaaattaaaaaaccaaaaaaaaaaaaaacaaaaacccacacaattaaaaatagaaaaattaagtccgcaagagcacataggtgaagaggaagcggtggctgatctgggcggaagctggaggtcactgggagtcaggaatgcagcactcatcagtacgaaacccggaaacagctcctagaaggccctctgagctttgaaatctgctgctttacaaactttcttcaggactctcctttgccttccagcaataatcagcatgtcaacgatggtggccttcatctttctttttccttgtcctgtcaccccaaatgagttttgcggggttttttttaatagagatggggtctcttcacgttgcctaggctggtctcagactcctggactcacacaatcctcctaccttggcctcctaaagtgccgggattacaggtgtgggtcaccgcacctggccccaaatgcgttttaatttcctcagtaactcctccctgctccatacacacaggactggggaaccttcttcctccggcagccaaagccgccaagacctgcaggtagtcccaccaggcaaaggggcctcagagcgtatccaaagctccacagagacggaattcagcagagctgcacgctaggatttgggggactttttttttggagagagggtcttactctgttgtgcaggtcagtgtagtaacacaatcatggctcactgcagccccaaagtctgccaggctcaagtcatcctcccaccccagcctcctgagtagctgggaccacaggtcagtgcccccatagctggctaattttttaaattttttgtagagacggagtcttgctgtgttgaccaggctggtctcaaactcctgggctcaagtgatcctcctgcctcgacctcccaaagcactgagttcccaggcatgagccaccacaccaggcctgtatttcgggaacttttaaaattattggcaaaattcaattaattcccagagttgatccagcccaaagaaccatctggatacacttatccaggaaaccaaaacagattctggtaaaactcctctcactggtagcttaagatgaggacctgtccaaagtttaatgctttctcacagctaatatattatctggcaattctccagaatggcataaaaaccagctttgtgaaaagaaactttgctagcatcgggcatggttagcagggaacgcacctctttttctgagtacagggaccgggcaacaatgtccaaaagcttctttgtctcggcctggaactcatgtttggaagtggaacctagtaatgaaacacagacacaaccaacaaagtttaacttctatttttgtgcaagaatacgctacgtcacattccaaagaaagcttaagtttatgagttttaaacttttttttttttttttttttgagacggagtctcgctctgtcacccaggctggagtacagtggcacgatctcggctcactgcaagctctgcctcccgggttcacgccattctcttgcctcagcctcccgagtagctgggactacaggtgcctgccaccacgcccggctaattttttgtagttttagtagagacggggttttaccatgttagccaggatagcctcgatctcctgacctcatgattggcccgcctcggcctcccacacatttaagatcatgaacaaaaagaaagaagcagacagaaacaaagtctggctgggcaccatggctcatgcctgtaatcccagcactttgggaggccaaggcaggagaatcacttaagcccaggagctcaagaccagcctgggcaacacagagggatcccgccatctctacaaaaaatacacaaagtagctgacggtggtggcacacacttgtggtcccagtgactcagggggctgaggtgggaggatcacttgagccagggaggtcgaggcttcagtgagccatgattgcactacagcactcggcctgggtgacagagaaagaccctgtctcaaaacaaaacaaaacaaaaagtctctcagaaaggaggtctcagggcaggacaaatcctcccactgctgaggccagacatgcctcgggctatgtcgagggaatgctgagcctggtttcccaatgtgcatggttacgagaactggactgcctctaagaaccagattatatgttctttcttttttttttagaggcaggatctggctctgttgcccaggctgctatgcagtggcaggatcgtgctcactgcagcctcaacttcctgggctcaaccgattctcctgcctcagcctctcaagtacctggaaccactggtgtgtgctaccatgcctggctaactttttaatttttttctgtagagaaagggtctatcttgcccaggttggtctcgaccacttggcctcaagcaatcctcctgcctcggcctcccaaagtgctgggattacaagtgtgagccactgtgcctggactatattcttcaaaaaagcggtttccaaattaattagttagaaatcaaaataacaagaaaacctcacttctctttttaacttcaaagattctactcttgtcgacccacttaaaagccagaaatggagccacttcaggactggctccaaagactgcttttttatacttcagagggaatgaaaagacagctccagaattcggtcctgcgcagactgggccaatgctgagtttcccctcccgcttccatgattattagcagatgtgccatgaatcaccactcaggggaggtgccggacggcaaactcacgggtggccaccagagggggcaagacacacccgacactggcagaagtccctcgctgggacagaaatggagggcgcagcactccctacagccaagaccttctgatttcacacctaaggcggtggctctaccaatcactgcctccaccctgaaaatgcccctttacgcacagcagtgaaccaaaaagccctcccagaccaaagcacgagccaaggctaccctgcacgctctctgtgctgctgataatcgagtgcaggggttcctccttgtcctcggcggtctgcgtgctgaacagtcgtcctgcctgcaagctccaggctgggtttcgcctggggcccaactgggctgtggtcctccgaggacacagaattggttttcctgaaaagacaaatatgcagaaagaatgagaattaggaagacacgagaaacaatatggtaattcgtcccatcaagggtgtctagcagaagctagcgtggacatctctaagtcgggctgttgctgaaagagaaatccacaggaccaaatgccacagtgtcagggtgtggttttggcaaggagccctcacagatgtcatcagtgtaagatactgtgtcttctcagaaccgcagaagcgaaactggagggggtgggctgctgccttcttttcagagggggtctcgctctgtcactgcgatcacagctcactgcagccccaacctcctggactcaggcaatgctcctgcctccgcctcacgagtagctgggaccacaggcacagaccaccatgcccccataattttttaaaaaattttttgtagaaatggggttttgctatgttgccaagactggtctcgaactcctgggctgaaaccatcttcccgccttggccttacaaagagctgggatgacaggcgtgagccaccatgcccagctggcagatgcctgctgacagcacttcccacattcgcctcacgggtgacacctcgcatcaacctaccaaactgaaacctgtctcgaccctcgcagcccctgcagaagcccccgatgggccacacttctttgctcttgacagtcaagcaaaaaaaaaatcctcccaaaagggatccaaatatttaaatgttaatattctgaaactgtctcatcttctaaaagttgattctttcccattgctttttcatccaaaacagattttttaaaaaaaatttgtgtactttaaaaactgaaaaacagctgacgatgggttctaccttctaactaagaaggagacttgtcttctgtaacttcctgctcagtccagtgggctgagaaagttgccggcagagcccagcgagggaggaaagcagccaatgtgtccccagccgcacgcagttcaccgacgcaggcccagaaaccagacactttcactccaacacaggactggaccgacccaacaccaacacccactgaccccagggaccacataccaggaccctgccttggtcagtagatttgcaatacgtgatggtgtcaaggatatgtggccagccagccacgccgtgtcaaagtctaagcctaaatgaaccgcatctaactgggagcctctcctgttcttcacaaatttgtaacaagtagaaaggaaagacaacagaatatccaggaatcaaggttttaaaaatcagcatatcagccaggggtgcggtggctcacgcccgtaaacccagcactttgggaggctgaggtaggcggatcacatgaggtcaggagttcgagaccagcctggccaacatggagaaaccccatctgtactaaaaatacaaaagttagccgggcatggtggcaggcacctgtaatcccagctactcgggagactgaggcaggggaatggcttgaacttgggaagtggaggttgcagtgagccgagatcgtgccgctgcactacaggctgggtgacagagcaacattctgtctcaaaaaaaaaaaaaaattaacatatcaactttcatactcctaaaaggtacaaaaacttgccttttttttttttttttttttgagatgaagtctcactcttgttgcccaggctgcagtgcaatggtgcaatctcggctcattgcaacctccacctcccgggttcaagcgattctcctgcctcagcctcccgagtagctgggtttacaggcgcctgccaccacacccagctaatttttgtagttttagtagagacagggtttcaccatgttggccaggctggtctcgaactcttgacctcaggcgatctgcccacctcagcctcccaaagtgctaggattacaggcatgagccaccgtgcccagccaaaacttgcctattctttaggcttattcctggacttacaaacagcacaaacctggccttttgtttttgtttttttttgagatggagtctcgctctgtcgcccaggctggagtgcagtgatctcggctcactgcaacctccatcttctgggttcaagcgattctcctgtctcagcctccaaagtagctgggactacaggcaccagccaccatgcctaatttttgtatttttagtagagacgaggtttcaccttattggtcaggctgctctcgaactattgacctcaggtgatccacccacctaggcctcccaaagtgctgggattacaggcgtgagccaccatgcccggccaaccctagcctgtctttatctctatgcagataccttaaaaacatctaccacaattcagaaagtattcaaattccaaaccatgtaaacatccagttatttgggcccatgtaattgcattgttcactttattcgtacagttaaaaaaaaaaaaaaaatcccgggacatttcttctggaattaaatggtatttggcattagaggagttcgcgaacagtctacatcaaaccagggtgctgaagtctctgtgcctccttccaaagcacagccagccctgggggcacaggagggaagtgtccaagtgccaacacctgcccacagagcatatcagtgtttctcaccatttgtgtaaaagaaacacaaaaaggataaaccagaaactgatgtgactgtgtattttgtttcctaggactactgaaacacagcaccacaaactaggcagtttcaaaaaggtccacagttctgagccaggcacacaacctcacacctgtaatcccagcactttgggaggccaaggcaggagaatcgcttgagcccaggggtttaagaccagcctgggcaagaaagtgagactccatctctgcaaaaaacacaaaaactagccaggtgtagtggtgtgcacctgtagtcccagctacttgtgaggctgaggtgggaagatcacttgagcccaggatgttgaggctgtagtgagccaagatcacactaccgcacttctgcacttcaggctgggtgagacagcgagactctgtctcaaaaaaaaaaaaaaaaaggtcccaggttctgggcagcggtgcttcccactggaggtgccgagggagagtccatcccgcacctctccccagcttctggcagtagccggcatccttggtgtttcatgctttgcagaccctccaggctctgtctcttgtcacatggcaagctcttctctatgtgagtcctggctgtgtccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttgagacagagtctcgctctgtcatccaggctggagtgcaggggcatgatctcagctcactgcaacctctgcctcctgggttcaggcgattctcctgcctcagcctccctagtagctgggattacaggcacgcaccaccatgcctggcttttatttttaaaagagacatggtttcaccatgttggccaggctggtctccaactcctgacctcaagtgatctgcccaccttggcctcccaaagtgctgggattacagacgtgagccaccatacctggcctctttttaaaaaagaataaaaatagagacaaggtttctctttgttgcccagcctggtcttgaactcctggactcaagtaatcctcccactttggcctcttaaagcactaggatgacaggtatgagccactgtacccggccttcaaaccccacagcttggttacctacaggaggtgtgtattaaactccccgtggcacaaacccggtagcttacagtaacagacacttattctctcacagtcctggaagcaagaagtccaagatcaaggtgccactagggctggttcctcctgaggctgggagggagggtctgtttgcgcctcttccagcctctgcagcctctggcgttgcttggcttgtgggtggtcatcttctccctgtgtcttcccttcaggacgtctgcccttctccctctacacatgtctgtctgttcaaatgtccccattttataaggacacagtcatactggattagggcccacccaagtgaactcatcttaacttgatcacctgcaaagaccctatttccaaatatggtcacattcacaggtactgagagctgggacttcaacatctttcgtggggagacacaattcaacccccaaccagcatatgtacagagaatgcaaagaaagcgggaaggggagagggctggcagagctgagggaacatgacacttccacatacatcttttcgtatgtctctcttagaaccatggtcaggtttctcatactcaaaaaacaaaccattacttagccagacgtggtggcgcacttctagttatcagctactcgggaggccgaggtggaaggactgctcgaacacaggaggtggaggttgcagtgagccgaggtcgcaccactgtactccagacttggcgacagagtgagactctgtctcgaaaaaaaaaaaaaaagaaaagaaaaagaaaaagaaaaagaaaccgtgaaaacaaaacagggcgcacatgaacacaaaatgaaatacaaacagcaaatatgcagagctgtgacgatgacatcaccactctgaaagaagaactaacctaagagacttcagaaaatagcactttgactgttactgtaaaactaacctcagaggacagcacaccatcaccaggctcgggcaggagatgtgtcccctgcggagtcagcaggtctgagcccgatttacgcatgtgccaagatcaagcggaaaagctgattgtggctactgagttggggtcctcacagttgaagaaaagtcactgataaggaaggggcaggaataaaccctgcggggcggcactggaggtacaggcatcagtacaggctcacaacctttgccatgtgtacagactggatgcagaaatcaataccggaacatttacacacacacatttcccagctctgtccactgacgcgtgacagggcccaggcgcgatgaccccccacttaggctacagagagcaaagtccaaaagctgttccagtttcagcactctaaagtcccacgtcccagggaaagcctttgtcctggcaaactaggacggctggtcaccctacctggcagccagatcttggtttgtgaatacctctctccaaaaacaggaaccagagatccctgcggagcacacagaggagcctaggacacccagtggtgtgcagaaggacgagaaaggacggggtgtgtcaggagaacacacagcccagccagaagggctcccagtggcagaatctaggacaatctgtgcggcaaaataacgaacgacaataatggattgtaagctgtgacccggcaaatcaagcaaacatcggtgcacacttaaacagaggaggagcagcagctcttcatcacagcagaattccaatgaataaacacaaggaatggcagaaaacagaaagcacaccatcaggaaacaccacagcaataactggctggtgtaagttactactattttgagacagggtctcactctgttgcccaggctggatcacaatggcacaatcacagctcactgcagcctcgaccttcccgggctcaggtgatcctcccacctcagcctcctgagtagctgggactataggccgtgtattaccactcctagctaattttttttttctttttttttttgactgggtctcactctgtcgcccaggctgaagtgcagtagagtgatcttggctcacagcagcctcaaccctccggattcaagtgatcctcccacctcaaccttccgagtagctgagactacaggctcatgccaccatacccggctaatttttgtgttttctgtagagacagggattcaccatgttgcccaggctggtctcaaactcctgagctcaagtgatcccccggcctctgcctcccaagcgctgggattagagccgtaagacaccacgcccagcctaaggttatgtatttgaagcagtggtagatactgccaagtcacactccacagagatcctatcagtttacgttcccacagcaatgtactaaagtgcatatcatcctacattcctgccaagtcagtgttgagatgaaactcttggatctttgcctattggtcagataaaattttcactgcagttttcacttacatttctcttattataagcaaaactgagcactgtcccgtatttttaaatatttcctatttccttttttgttaagggactgttggtatcctctgataatttttctactacattttaaatcttcttcttattgatttgtaagagctttttatatattaaggaaattagtcgccaggagcggtggctcacacctgtaatcccagcactttgggaggccgaggcgggaggatcacgaggtcaggagattgagaccatcctggctaacacggtgaaaccccgtctctactaaaaatacaaaaaattagccaggcgtagtggtgggcgcctgtagtcccagctacttgggaggctgaggcaggagaatggcatgaacccgggagacggagtttgcagcgagctgagatggcgccactgcactccaccctgggcaacagagcaagactctgtctcaaaaaaaaaaaaaaaaggaaattagtcttttggttgtaaaagccttcctcactctaagattaaacatgatttccccatgtttcatttttctagtctttttggtttttccccaattaatatgcagaattttttttttttttcctcgagaaggtcttgctctgttgcccagagctggagtgaaatggcgtgatctcggctcactgcaacctctgcctcccaggttcaagcaattctcctgcctcagcctcccaagtagctgggattgcaggtgtgcaccaccatgcccggctaacttttgtgtttttttgtttttttgtttttcttttttaagtagagacagggtttcaccatgttggccaggatggtctcgaactcctgacctcgtgatccgtctgcctcagtctcccaaagtgctgggattacaggcacaaaccactacacccagcctatatttttgaaaggatttaatataatattcattatgggaggagtatatagaagtcctcacaattgggaaaaagaaaaaaataagaaatctatatttccagccagaattgcaagacttagtatcataacgccaagattacattaattgaattgacagcattcttaaaagcagatttgatttcaggttatgtaaactttccacaacaacttttttttttttttttagagtctcactctgttgcccaggctgcagtgcagggcgccatctcggctcactgcaagctccgcctcccggattcatgccattctcctgcctcagcctcccaagactacaggcgcccgccaccatgcccggctaattttttgtatttttagtagagatggggtttcaccgtgttagccaggatggtcttgatctcctgacctcgtgatctgcccgcctcagcctcccaaagtgctgggattacaggcgtgagccaccgcgcccggcttctacaacaacttttaatcactaactcaggtgcagtggctcatgcctgtaatcccagcactttgggaggccaaggccggggggtcgcttcagctcaggagtttgaaattagcctgggtaacatggcaaaaccccatctctacaaaaaaacagccaggtgtggtggtgcatgcctgtagtctcagctacttgggaggatcacttgagcctgcaaggcagaggttgcagtgagccaagatcacgccactgcatttcagggtgggagatgcagccaggccctgtctcaaaaaaaaaattaaaaattaaaaaaaaaataaaccattagaggaataaatctgcctgaaccagataccaaacacgctagctgtacaatttccgtctttgtgtttctcctacaccctaaaggaaaaaccacaaacctcaatgtcaggctacaagatcttactgttaaactatctggtggtttggggtcgcacaaaatgggaagcactgatagtttgaatgtgacaccacacacccctccccttccaccccccacatccctacccactactgccagtgcccatgcagctcctccactctgcagctgcagtctcagtagctgggactccttcccatccgagttgctgcagggcctggctgcaggccctctctcccattcaggcctccctggccccagcagttcacaataatctcttcctatgagttcactgcacttaactttttatgctgcccatttaaaaaaattttatactggccaggcgcagtggctcacaccataatcccagcactttgggaggccgaggcgggtggatcacctgaggtcaggagttcaagaccagcgtgaccaacagggtgaaaccccatctctactaaaaatacaaaattagcactgggtgcctgtaatccccgctactcgggaggctgaggcaggagaatcacttgaacccacgaggcagaggttgcggtgagccgagattgtgccattgcactccagcagcctgggtgacaagagtgaaactccgtctcaaaaaaaaaaaaaaaaaaaaaagatttattcatgtatttactatttctttctttcttagaaaagagattgctctgtcacccaggctggagtgcagtggtacagtcatggctcactgcagtcttgaactcctgggctcaagggaccttcctgctttactctcctgaacagctgggactgcaggtaagcaccatcacacaggactaaattcttttttttttttttttcctagagatagggtgtttccatgttgaccaggctggtcttaagctcctggtctcaagcaatcttcctaccttagcctcccaaagctgctgggattacaggtctgagccaccacgcccagcctgtgctgctcatttgaaactgctgctatatgccagcatatgacatttcccactgttaattttttggttaatgtataatttatctcaccaaattagggcaggaaaaagcttgtatttctcagtaacactctttgaagacaggaacatccatatttcttggtatgccaaagtatctatcacaaaagctactctttacaaacttttttttttgagatggagtttccctcttgttgcccaggctggagtgcaatggcgcgatctcagctcaccccatcctcctcctcccgggttcaagcgattctcctgcctcagcctcccgagtagctgagattacaggcatgtgccaccacgcctggctaattttgcattttttgtagagacggggtttctccatgttggtcaggctgctctctaactcctgacctcaggtgatccgcccacatcggcctcccaaagtgctaggattacaggtgtgagccaccacgcccagacttttttgtttgtttgtttgagatgcagtctcactctgttgcccaggctggagtgcactggcacaatctcggctcactgcaaactccgcctcccagttcaagccattctcgggcctcagccgcccgagtagctgggactacagatgcacatcaccacgccaggctaatttttatatttttagtagagatggggtttctccatgttgcccaggctggtctcaaactctggggctcaagggatcctcctgcctcagcctcccaaagtggtgggattacagaagtgagccaccgcacctggccaagggtgcatatttcaaacaccagagtaaccactaaaataataattcaaagaagaatagctttaaaaagcattagataaaccacaatggaaatctcaaatacatttcattgataaggaaaggaaaaacagggaaaaaatccaaaaggacaaataaaaggcaaataataaaatggtagcaataaatccagccacatcgatatttactcttacattaacagactgaactctaattataaggcaaggattgtcagaattggtaaaggaagacctaattacatgctatctacaagacactttaaacataaagaaaaagatacacttaagacaaatgaatggaaaaatacataccatccaaaaagtgtgtttaagaaagctggagtggctctattaatatcaagtaaaatacatttcaaaataaaaaatattattaggaaaaaagaaggatatttcagaatactacaacaaacaattcatcaggaaaatgtaatcacaagtgtgtatttgcctaataacagagcttcaacatatatgaagttaaaacggaaagaattaaagacaaaacaattccacaatcacagctggagatcttaacactcctctctcaataactgacagaatcaaaccaaaaaataaaacagaagccgggcacagtagctcacgcctgtaatcccagcactttgggaggctgaaacaggagaatcgcttgaacccgaggcagaggttgcagtgagctgagatcgcgcccctgcactccagtctgggtgacagagtaagaccctgtcccaaaaaaaaaaaaaaaaaatagccagacagtccagaagaaaaacctggggcaaaagatatgaacggcatttcacagtggctacagaaagcgaaggagcaccaaactatatatgaacacagcaagctctccacgagctatgtagtgagtaacagaacacagagaagggtgcgtccctgagggaatatgtacatctgcacttactacagtcatacaagtaagtagtggcaggacccacaggcaactaatagtggttatgaagacagcaggtgctctgaacagcagcaagacttctcaagctttacctgttcacatggttttggttaatcaaaccatatttatttattcaaaacagatattaaattattaaaaatatgaggctgcccggcacggtggctcacacctgttatcccagcactttgggaggccaaggcaggtggatcacaaagtcaggagttcgagaccagcgtggccaacatggtgaaccctgtctctactaaaaatacaaaaattagctgggtgtggtggcgtgcacctgtaatcccagcctgggcgacacagtgagactccatctcgggcgggggaaaatatgaggctgtcacaaaagtgctaatgttttccctgctgtcgatgttgaggtcacttgaaagctggtatggacacatcggatgaggaattcagtctaggggcctcttaggagccaaggcccaatgactagactaagtggacccagcaaacacagagggagggggcctgaggcacaaacacagacaaggtcctatgctcgaggcaaacaaggacgaggtacaaggtgagagccagaaggggccactgtgctgcttcacagacctgggaagaagttttttgagaaaagactttcatttttcaagaggcagatcattttaaagaataaggcctagggcagtggctcacacctgtaatcccagcactctaggaggctgaggcaggcagatcgcttgagcccaggagtttgagaccagcatgggcaaactggtgaaaccccgtccctaccaaaaatacaaaaacttaggtggacatggtgacacgcacctgtagttccagctacttggggtacttgaggcggaaggatcacttgagaccagagggtaaaggctgcagtgagccgagatcacaccactgcactctagcctgggtgacaaagtgagaccctgtctttaagagaaatttaaaaagctgggtgcggtggctcacacctgtaatcctggcactttgggaggctgtggtaggcggatcacctgaggttgggagtttgagaccagcctgaccaacatggagaaactccatctctactaaaaatacaaaattagccaggtgttgtcgtggatgcctgtaatcccagctacttgggaggccgaggtaggagaatcgcttgaacccaggaggtggaggttgtggtaagccaagatgctgccattgcactccagcctggagaacaagagtgaaactccgtcttgaaaaaaaaaaaaaaaaaaaaaaagcattcagtaagatggtagaatacaaaaatcaacacccggacgtcctatatacagaaaactagttagaaaatatgacataagagaccccaggaacaaaaactaaacaattaagaatgcatttaccaagaaagcaaaatctttccttttttttcttttttggcaagatcttttaagaaaactctgaaacactactagggccaaagactgtcattaaataacccacttaagactgttacatatgctacatactcacaagcggaggactaacaagtaaactacagacgtaaggtaacacttggaaagcatgggattatagagaaatgggacaatgctgtgtaatgtgtgctgatgctgaattacctctaacacaaagaaaaaacactagaggtagaacagcggtttgcacacactaccatggtgttcaaatgcatatacatgttatgtgatacatgcatgcatagctattctcatatgccacgcagatctctgcaaggacacccaaaaactggctaatggacttgccaccaggaggggtgttgtctgaggcatgtcagtgggagacgagtttttcatcagatatacctctgtatcgtttgcatattggactacatatatcaataatctacaaaataaataccctacttataaaactatttacaaaagttaggctgggcgcggtggcttacgcctgtaatcccagcactttgggaggccgaggcgggcagatcacgaggtcaggagatcaagatcatcctggctaacacggtgaaagccagtctctattgaaaatacaaaaaattagccgggcgtggtggcgggtgcctgtggtcccagctactcgggaggctgaggcaggagaatggagtgaacgcgggaggcggagcgtgcagtgagccgagatcgcgccactgcactccagcctgggcgacagagcgagaccccgtctcaaaaaaaaaaaatcaaaaaacaaaactatttacaaaagttacattacaggccaggtgaggtgcctcacgcctgtaatcccagcactttgagaagccaaggtaggcagatcagctgaggtcaggggtttgagaacagcctggccaaaatggtgaaaacccgtctctactaaaaatacaaaaattagctgggcatggggatgcacacctgtaatcttagctactcgcgagaccaacgcactagaatcgcttgaacctgggaggcagaggttcagtgagctgaaattgcatctctgcactcgagcctaggcgacagcacgactctgtctcaaaacaaacaaaacgttgcattataaaaaacacttaaaaacttacgagaaacataaacacatttacaaaatttcaaacacatttttaaactattctcattctaaaattcatgtggaaaagttagtgtacataaatagccaaagaaattttgaaaaaactgaggaaattcatcaaatattaaagaacattaatataaagctacaatattaaaataaatttccagaccaggcatggctgctcacacctgtaatcccagcactttgggagggagatccaggcaggaggaggctccctcgagctcaggagctcgaggccagcctaggtaacatagggagacccccccaactctcaaaaagtaaacacacacaaaaaaaggttaaattaatttccagcagggcacaggggctcatgtttgtaaccccagtgctttggaaggccaagttgggaggaacacttgaggccaggagttctagaccagcctgggcaacatagcaagaccaacctcttatttttttttttttaatttccgctgtcacttattaagtcaaaatgaattccagatggaccatagaagtaaaaataaaagctaaaagtactgaaagaaaacatgaaagatttagtaactttattgagatgtaacacatctgccatataattcacccaagtgcacaattcagtggttttagtatattcacaaagttgtacagccacgaccactaaccacagaacatttttttttttgagacggagtctcgctctgtcgcccaggctggagtgcagtggagccatctgggctcactgtaagctctgcgtcctgggttcatgccattctcctgcctcagcgtcccgagtagctgggactacaggcgcccgccaccacacccggctaattttttgtattttttttttagtagacacagggtttcaccatgttagccaggatggtctcgatctcctgacctcgtgatccgcccgcatcggcctcccaaagtgctgggattacaggcatgagccaccatgcccggacaactacagaacatttttatcaccccaaaagaagccctacagccactcatgttcactctcttttccctctcccaccagctcttggcaactactcatctatgtctgtctctatggatttgccttttctgggcacttcacagaaatgaaatcatacaatatatggttttttgtctggcttctttgacttagcataaagtctttggggttcatccacatatagcatgtatcagcacctcattcctttttataactgaagagcactccgctgtatagattatttttttccattcatcaaatgatgggcaactgggttgcttccaaattttttgtgagacagagtttcactctcgttgccaggctggagtgcaatgacatgatcttggctcactgcaacctctgcctcccgggttcaagtgattctcctgcctcagcctcccgagtagctgagattacaggcatgtgccaccacacccggctaattttatatatatatatatttttttttagtagagacggggtttctccatgttggtcaggctggtctcaaactcctgacctcaggtgatcggcccacctcggcctcccaaagtgctgggattacaggcgtgagccaccagtcccggccctttttttctttttttttttttgagacggagtctcactctgcagtggtgtaatctccgctcactgcaacctccaattcccagggtcaagtgattctcctgctgaggcacccgccaccacgcccagttaatttttgtatttttagtagagacgggttttgccatgttggccaggctagtctcaaactcctgacctcaagtaatccacccacgttagcctcccgaagtgctgagattgtagacatgagccactgcaccaggcccagcttccaactttttactgtaacttttgttttggggtggggtgggggtctcactatgttgcctggagtgcagtggctgtttacaggcactgtcatggtgcatggtagcctccaactggcaggcttaagcgatcctcccacctcagcctcccaagcaggtgggattagaagggcgcaccaccactcctggcctatttgcactcttttttttttttttttttttttgagataggttcttgctctttgaccaggctgaagtgcagtggcacaatcacagctcaatgtagcctcaaactcctgggctcgagcaattctcccacctcagcctcccaaatggctgggaccacaggcatgtgccaccacacccagcaatttttaaaaattttttttcgagatggagtctcactatgttgtccaggctggcattcaactcttggcctcaagcaatcctcctgccttggcctcctgaagtgctgcaattacaggcatgaccaaccgcacccagcctcgtttccaccttctgatggaccttcagattgttttcattttcgggttattatgaataatgctgctatgaacattcatgtgtaggctgttctgtggacatgttttcatgtctacaaggtatgtgcctcagggtagaactgtggggtcatatggtaattcggtttgactgtgtgaggagctgcaagaatgttttcctgcagaggtcgcaccgttttacattctcaccagcagtgtgggagggttctgatttttccacatcctagttatccattttgtatcacctgtttttttgttgttgtttctttaatttttaattatagccaccctagtgagtaggaagtgctaactcactgtagttttgctttgcagttcctaaactgccaggcatcttgagtttttaaaaaaaatgatttaagaggaaatctttttttttttttttttttgaggcggagtctcgctctgtcgcccaggctggagtgcagtggcgggatctcggctcactgcaagctccgcctcccgggttcacaccattctcctgcctcagcctcccaagtagctgggactacaggcgcccaccaccacacccggctaatgttttgtatttttagtagagacggggtttcaccatgttggccaggatggtctcaaactcctgaactcgtgatccacctgcctcagcctcccaaagtgctaggattacaagcgtgagccaccgcgcccggccttaagaggaaatgtttctaaacaaaatatataacccaaaaggccataaatataaggaccacataaaaatttaagtcaaaagacaaacacccgggtgaggtggctcatgcctgtaatcccagcactttgggaggctgaggtgggtggatcgcctgaggtcaggagttcgagaccagcctggccaacatggtgaaaccccgtctctaccaaaaatacaaaaattagctgggagtcgcagcgggcatctgtaatcccagctactccagaggctgaggcaggagacttgcttgcactcgggaagcgaaggctgcagtgagccaagatcgtgccactgcactccagcctgggcaacagacagagcgagactctaactcaaaaaaaaaaaaaaaaaagacaaacacattaagaaaaaaactgggggccaggcacgacggctcctgcgtgtaatcccagtactttggcaggcagaagtaggaggatcacttgagaccaggagttcaagacaagccggggcaatatagtgggaccccatctctaaaaaaaatgttttttaattagccaggcatggtggcacatgctccttgggaggaagaggtcacagccacttgggaggatgaggcaggagtatcacttgagtccaggaggtcaggcctgcagcgagccaggatcgcacaactgcactccagcccggatgacaaagcaagaccctgcctctaaaataaaatttagtgccgtggctcacgcctgtaatcacagcactttgggaggtgggggcgggcagatcccgaggtcaagagtttgagactagcctggccaacatggcaaaaccctgtctctactaaaaatacaaaaaaaaacaaaaattagccagaaagccaggagcagtggctcacacctgtaatgccaacactttgggaggctgaggcggatggatcatgaggtcaggagttcaagaccagcctgatcaacatggtgaaattccatctctactaaaaatacaaaaattagccgggcgtggtgacgggtgcctgtagtcccagctactagggaggctgaggcaggagaaatgcttcaacctgggagacggaggttgcagtgagccaagattgtaccactgcactccagcctgggcgacggagcgagactccatctcaaaataaataaataaataaataaaaataaatgagccgggcatggtggcgcgtgcctgtaatcccggctacttgtgaggctgaggcgagaggactgcttaacctcgggaggcggaggttacagtaaggtgagatggcgccactgcactccagcctgggcaacagagtcagactctgtctcaattttttttttttttttgagatggagttttgctctgttgccgaggctggagtgcagtggtgcgatcgcggctcactgcaagctccgcttcctgggttcacggcattctcctgcctcagcttcccaagtagctgggactacaggcgcccgccaccatgcccagataattttttgtatttttagtagagatggggtttcaccgtgttagccaggatggtctcgatctcctgacctcatgatccgcccgcctcggcctcccacagtgctgggattacaggcgtgagccaccgtgcctggcccgacactgtctcaatttttaaaagttatttaaaagggctagcgcagaggttacggtgagccaagatcacgccactgcactccagcctgggcaccaagtgcaaaactccatctcaaaaaaaaaaaaaaaaaaaagaaaaaggccattggttcaagagaaaaatggccattcacaaaaacaagaaacatcaatggctttacgtcctagtaaaagatgttttaccacactcataactaaggaaatgcactttaaaacgagatagcattttcactaccagattgacagatgttttaaatactgtcattctagcactggtgaaggtgtgagaaactgttggcaatgccgtctgttatcttggggaaactcagcaacaacctaaatgtccgccatgagagggttacataaattacaaaacatcctcgctatggaataccagagctctgtggcgacaggaaacaaaccccagaatataagtggaaaatgcaaggtacggaagattacacacggttccttcccagtttacctttgtttcccttttttttgtgtgtgtgtgtgagacggagttttcgctcttgttgccaggctggagtgcagtggcgccatctcggcacaccacaacctccacctcccagattcaagcgattctcctgcctcagcctcctaagtagctgggattacaggcatgcgccaccacgcccggctagttttgtatttttcgtagagacagggtttctccatgttggtcaggctggtctcaaactcctaacctcaggtgatccacccgcctcagcctgccaaagtgctgggattacaggcgtgagccaccgcgcctggcgagaagattcttaagtacatgaacattctgaacagaaagacctgtattccctcacaaatgtctgagttcttagctctggcattctcaacactcactgtttcttgaggtttcctgtgttccagaacctggtctaatcgttctctactatgatatactgatacttcattcatcaggaaacataactccttgaacataaagaaaaagaacaaaaagcgaaagggcacctcggaatagtcaaaatatgggcctgaagccctcaccctgagctttgctcatggaagactactggccccatatgaaatccatctcattctaacaatttgatgctaacaagtttcccagccacatctgcaaactaggaaaggagagaacagggctccagacagacctgcaagttaaggccacagtaagagaggccaaaaatataaacactcacaatgcagttttgatgtggggacacttcatagacgaaggattcttcacatttcaatggccctacgggagcctacatattaaaacagaagaccaaacattaacacccgtaataatgaccctgaaaacatccaagagaggttcagtcatgggccatcaaatgatggagtgttctagaaagacttctcatcataatggttaaaatgaaatgttttaaagtcagcctcgtggaaaattcgcttgaacattccattgcctgacaaatgctgaaatactggcaagtgtgaactaacatggcaatgtgctgtcttaatttctccttcgaggtgcatatcactaacccgacacacatagttacattagaaggacccacgtccttctgtcttcttctcagcagcattgctgaatagcctcctgctcttaatatggcatttaatttagctatctcaaaattaatttcttttatatgtgtgtgtgtatatatatatatatatatatatttttttttttgagacactgtcactctgtcacccagactgtagtgcagtggcgtgatcacagctcactgcagcctcgacttctcaaggcttaagggagcctcccacttcagcctcttgggtagctgggaccacaggcacacccagctaattggaaaaaaaaaaaaaagggttttttggtagagatgggggtctctctaggttgcccaggctggtctcaaactcctaaactcacaggatcctcccgccgcagcccccaaagtgctgggattacaagcatgagctaccaggcctggccaattttttaccttctagccacatttcttaattatatggctatgaagtaactgagccattccttttaaaaccaatgattcagctacatgtcctttcaatctacccaatctacaggaattcacctggttaaaaagccaatggcagggctgggaacggtggcgcacacctgtaatcccagcactttgggaggccgaggcaggcagatcacaaggtcagaagttcaagaccagcctggccaacatggtgaaactctacctcaactaaaaatacaaaaattagccgggcacggtagtgcatgcctgtagccccagctacttgggaggctgaggcaggagaactgcttgaacccgggaggtggagattgcagtgagccgagttcgtgccactgcactccagcctgggaaacagagcaagactccatcttgaaaaaaacaaaaaaaaaacaaaaaccaaaacaaaaacaaaaaaaacacaggtggcagtaatactcccgcaagtagatactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatgaatggatacattttcaatcgctatcaagattctttgtcaggcccgacgtggtagctcatgtctgtaatcccagcactttgggaggccaaagcaggcagatcaaaaggtcaaaagattgagaccatcttgcccaacacggtgaaacctcgtctctactaaaaatacaaaaattggctggccatggtggcatgcacctgtagtcccagctactcaggaggctgaggcaggagaactgcctgaattcaggaggcggaagttgcagtgagctgaggtcatgccactgcacttcagcctggcgacagaaagaatctgtctcaaaaaaaaaaaaaaaaaaaaaaaaaaaaaaaaaagatatgtcagcattttgagacaagcaagtatcacaggcctcagtaacagcctctttcatggaactcacctttgtcacatggtatttactgacatggggggcaggagtaaatgtttattttcccacagttttcttatcaacctgacacccccatccccaccccgcaagctgcattccctctcttcctgccaaggggtagcaaaatacttggagattcctcttttgtcttagcttaggccaactactcacccagtaaccaataaacgctttgctaatctcttacattcggattgatgtgtttgtttccaagacagagtcttgcactgtcgcccaggagggagtgcagtggcacaatcttggctcactgcaacctccaacctccacctcccaggttcaagcaattctcgtgcctcagcctcccaagtatctgggattacaggcgcctgccaccaccctggctaatttctttgtatttttagtagagacggggtttcgccatgttggccaggttggtctcaaattcctgaactcaagtgatccacccacctcggcctcccaaagtgctgggattacagacgagagccaccgcgcccggcctgatgtgttctttttcaggcactcagataactcagttcccttggtcctaactaagctgaaggtcctcctggtggccttggacagctgggccacaccttcctctgccgtctaagtgccagcaccacagcttaatcagacgacaaacatgtcatggacgctacacctctagcgtcatctcagcaacacaaagagctgtttcacagacagagtcgcaactgaccagcaagtactactcccctccactctgaaaagaacagccggagagcaccagaaattcacctgaattctcctgaagggtgcagcacacaagacacggaaatcaaacagcacaggctccaaacaaagggagagcagagggaggaggcaaaacccgtcaacaaaacgaagtactgaaggggagggcgcagcaggcaggcaccacctacaggagcggggtccaggtgaggctctttttggaagatgaaacaaactagctagtacttgagccctgagcaaagtgaggaaaccagctctcccgaccttcctggtgctggcaggggacctactctcacaactctgatttccaagacaggaagttccagcaaaggctccagcttacagagaacaaaaaggcccaagatcttaacgcctgcaccaaccagtcctatcgtggttgcctcagtcatgttctggcaatttcacgaaaacaagagcatctggcatgaccaggagactggactcggcacccttggtgattgtggcagtcacctcgtcatgcaaaatgaccaacccgtcaccgtacctgcctgaccacagaatcacgtttgctttgggagactgcgtctgctgttgatctttccaggtcttccctctcctttaggaggcggcctcatccttctactggcacatctgacacttctgacagttggagctctgacgaaaagctctcatggtgggccacgtggctgggctccccacacaccaggcccagggctggctctgtgactgtcctgaggaatgcaggatgaggctcctacgcacaagcttatatctgacagaaaagacacaactgctagcctcattcaccatcactcctgcacactcccgcaagtctttcatcaaaccaattattcagagctatctccttacccttgcacctgcagctttccagacatggaacgttcctccctcccctccagtgaaaacagccttggacactcggcccaaatcgctcctcatctgtgaaacttaccctggggcaagcagctcttgtttctctaatgtgctgtccaggccaccaagatggccctggtacactgctcagcagccacctatgactccagacagcagggtcacattttctttgacgactcgggggcattggaaatgtatttgctgaataaactgttatgggcaaaaatgacaaatataaagtccacaagcggatatcctagcccacccctcacagaaatattctgagggtaggccaggcgcagtggctcacgcctgtaatcccagcattttgggaggccaaggctagtggatcatgaggtcaggagttcgagaccaccctggccagcatagtgaaaccccatctctattaaaaatacaaaacctagctgggtgtggtggcatgcgcctgtagtcccagctacgtgggaggcgaagtcaggagaatcactcgaacccaggaggcggagggtgtggtgagctgaggttgcaccactgcactccagcctgggcaacagagcaagactccggctcaaaaaaaatcaaataagatattctgagggcaagtgacagggctggcagtgtcaggggtcagtgaggtctgaaagggtaagagggctgagctcatgggtgactgaggcagcgtagcatgggcgagaggattccacagacataagacacgcacacctgaagccaggcacatgctacaacctggaaatactttcccaagaaaagaaaaaaatttcaagaggtctggattttctacataggtggatctgcctaaactattctttctcccctgttgcacaagacatgtattttcttagctaaattctctcatcgttcaatcaatccaaacaatttaccttcccattcatccacacaggtgacaatgacaagggcacctgccacgcagaaggctgccaagaacatgttccatttcttagactcaggcagaggaatgcttgaaccaccgcaccagaagatggaggacgagaggagagagacaatttttaagaaaaagagataaagggctgggcacagcggctcacgcttgtaatcccagcactttgggaggccgaagtgggcggatcacgaggtcaggagatcgagaccatcctggctaacagggtgaaaccccgtctctactaaaaatacaaaaaattagccaggcatggtggtgggcgcctaaagtcccagctactcgggaggctgaggcaggagaatggcctgaacccgggaggcggagcttgcagtgagccaagatcgcgccactgcactccagcctgggtgacagagcaagactccatctcaaaaaaaaagaaaaagaaaaagagataaagaaacagaattaaaatgtccctgggctgaaaactgacatattttccaaatggaagggacagtgcatgatacaaagcatgaatcacaaacacctgtggacgcgagaccacaaacgacaaagagaaaaaatcttaacctccaagggggaaaaaacccgagtcagctacaaaagaaacgagaaccaaattaacagaacagttggccaggcacggtgacacacgcctgcaatcccagcattttggagggcaaggcaggcagatcacttgaggtcaggcactggagaccagcctggccaacatagtgaaaccccacctcataaagacaaaaaaataaataaataattgatcagacactggtgctagaagagagcaacagcatcactttctgagggaaaattattattatttttgttgttgagatgaagtctcactctgtcgcccaggctggagtgcagtggtgcaatctcagctcactgcaatctctgcctcctgggttcaagcgattctcctgcctcagcctcccaagaagctgggattacaggcgcgcgccaccacacccagctaatttttgtatttttagtagagacagggtttcaccatgttggccaggctggtcttgaactcctgatctgcccacctcaggctcccaaagtgctaggattacaggcgtgagccaccgcgcccggccacaaggtatcttttatagaccactggttttgaaaagacataagattcagcgttgaagaaaatacctttggaataggcagtcttgatgcctgctaaaggggatataaattgataaggcctttttggacaatttggcagtatctgctaacatttcaaaaatgcataggctctgaaatatcaattctaaaattctaattatgtaaggctaaagaaataccgcacgtgaacaaatatttaagtactcacccattctatgcagcattgtaataaaaagtaaaacctgaaataacctttattgcgtccactaataggacaatgtttaaacaaatgacacgtccatcatacagaatactgtgtggtcactggaaggcacatggacctgtatacactgacatgaaaagatgtggaaagaatgctgggagcgttaaaattttctgaagtacaacgtagcacaatgcatacatggtttaggctttttagaataaaaaatacttatacgcagacatttatatttacacgtataacactgtgtacagccccgaagcaatgccgaaactttcactgttgttacctccgagtggggactgggaaagcagaggttagggtcgttctctctgttttacaaacatttattggcgcatccatcaattccaggccccgaggacacagctgcgtcaacgacatcgagtccacctgctctggggacccggatgactgctataggttttgttcactgtggcgtccccagaacctgcacggcgccgggcactgagcgggcgctcacatgtgcgtccaatgaacgaattaacaaatgaaccctcagtgcgctactgggaggcggggaggggtaaagcacgatccatggaactagcacgatcaccccgagtgagtccattccccgcaacatgcacccgcaaagactccgcgctccgcagcggctccacctgcacgtgcgctacctgactggaccgaagctccaggagggacgaccccgcagccgctccgcccgaccccgcgaccccccaagacccagcctccttcagggctcccatgggcgggtggcgaggggagtccagccgaggaaaaggcagccaagctggagctggcgaggagcggagcgaaagtaaacgcgtctgccgcgcttggcctcgccggacctcccacgcctgtgaagcaggtgccggcgcctcgctccccggagcacagggacgtccctgccgtctccgtggcccggcccgcccgctgcccgtccagccaggacgccctcacctcccggcacggccgccagcgccggcgcccgcagcaaaggccgcaggcggcggccccacagcagcagcgcccgcagctcgcgcgccatgtcgtactcccagagcgccgcgcgcagccacgcgggaccgtacacgatgggaaggggcgggacggggctgcgcggggcggggcttcctc

SEQ ID NO: 453 - DNA, 171403 bp, Homo sapiens
gcagtgttgccatcggcgtgcgcgcgtgtgtgcgagtgtgacagcggctgtggctgtggccgtggccgtgggaggcgggcccggcggagcccagccgcggggggaccggcccgggctcccgctccccgagcgcgtcgcggccgcgtggcccagccgagccttgagaccaccccgcccctgccggtcgcagtcgcgatgtcggtggccgggctgaagaagcagttccacaaagccagccaggtagggaggcgcagaggagggaaggagggagggggacgcggaggctgcggccccccgaggctcccgggcctttgggactcctgttccctgaagggcctctctcggggctcaatttcttcccgcctaggagggcgcgagggtggggtgaggggccgcctgctctctcctcggcgtcttggcgccttctccttcccattccctggcccccggctctgccctgggccgttgtaaatcggagagattctgcggagcggagggcagaggtggcggccgcggggactcgggaggcggagacggagtgggcgtgggggggcccctacccgcgcgaggggaggacgaccacagggagtacgatgccggcagggcctcccccgagtctccagccgtttggttgggagagcctcgtggggggcccatcctccaccggccaccggcgcctccagagatgctgtgtatttggcgcttggctgtgtcccgctgagctccccgcgcgcgcatcgaaatggccccgtctggactgtgcccggctccccggctggggctctctaccgcggtccttcccctccccaccgtcttcccggtgtcggcccggggctgggcatcacgcttctgctcttacagagctgacagcctgcaggggagacacggagacagacacgtaaacaaacagtgctagacacacctccacgcacagaggatgacaaataacacagtgggggcgtcagggagagcttcccggaggaggagacatgtcatttgagaattaagtatgaggaagaattatggctgagggtgtgggatgataggaggaaagccgttctgagcagaggaaacaggaaaacaggaggggagacatgaaattgatgtgtgtgtgtgtgtgtgtgtgtgtgtgtgtgtgtgtgttgatgacaagcaaatttgtttttcaacatcaacattgcaggctcttccagctatggcagagctcacgttgtaaaacctgttccccaccagcaccgctgggtctgttgcttctcaccacctctccccgcaaccccagcccccattttgctagagccagggtagacagatttcattcaacgtccacatttgtggtgaggtctcatcctgcttctcccacaaattggcccatagaaagcaactgcaattagaagattctcttcttctagccccagttccaggctgaaaggcactgctgtcccctcactcacactctttccatatggaaactgggtgatgctgtttctagctgggggcactgggtggacagtggtgctattcaaggtgttaaggagccctggaggagaggctattcaggtgagggtggagatgatggattcaccactgaacccagggactttgaggggtctttgggacattcacatgtcactggcctgggttggggtgcatatcctgacctgcagctcagggggtgaggctggtactggagctacagatttttggtgatttccagcctaagcggagatttaaaaatgtatgtgtagacaaaagtgagaaaaggcacagcgagttaaaggcagactctagacagcacccccatttagggacaatgtttagcccagtaattgttgagcagtgaccactcaataaatatttattgaatagatgaaattttggggtggcacaacacaggaaagaaagaactcgtagatgacaggagagagaagaccatcatggaagggggacatttaaaggcaggagcaatcaacaagtgcttcagtgagctaggtattgtggagtgtcctcagctggtacagccaggaggccgagtgctgctgtgagcagagcagagcagagcagtgccagagtaatcgctggctgtacttgttacattggcttccttagcactggcaggaaatgaacctcctcttttgaaaacttttcctttattgggtatggacttcacaggggcaaatctcaaagataagcaaatctcagagataacgtaagcccttgggtgatttaagttggtttctgacagtaaccagaatgaatggttgaaatccttggaagttattggcactggagaaatattttgctagtcatgggtagtttggtttaactacctgtaatcagtacattaaaaatgaaatgaacagaacgtcttatttagtctttttttttttttttttcgcatgagcggaaataatttatgactttacctgaaaggagaggcatcacagattctctctgggcttcatagccatgttttgtggttaaaagtactcagtagatatgttttaatatgttctagaagtctttctaaaaaatcttgcaatgcaacaatttggtggagaaatcagaccggtttaatataatatgagggagctcaataataaaaaatgccagatgtttttctcagacaacattttaacagcaggttttaattcatacagaacttacctggggcaggggaagggagccccagatgatgtcaatggctaaaataatttccagggatctaggtctggctcagccactgaccagctctgtaaccttgggaacataacttaacccatctggaccttggtttctatctgtatgatgactcagggaatttagaagctatgtttctgttataaaaatgattgtggcaatggtttcacaactctgtgaatatgctgaaaaccactgaattgtacactttaagagaattgtatggtatgtgaaatatatctcaataaagtgatacgaatatgtctctgtgtctctgggtgtgtgtgtatgtatacatctcagtgctgaaattcttaagtaagttaagcatttcagagtaagacaaagatgataaagtggaccttttacagagaagggatccaggaccatggcaaactgagatagttttctgaaagataagcgaggtaaaattagctataacccggttaactgttccttttttcctgataccttccctatctctgggaaaaaacccctactttacagagaatgaagactcgtaaaccctggggattatgcatcattttggcagcacatggagaccaacaggaaagaggaagaaatatgctaaaatgagaagaatataagttaacaaaaaaatttaattaattctaagtttcagcgtttgagactagaacccaaatttttctttttttttttttttctaatatgcattatcctttattaaaatgggatatttttctttttttttttttttaaggttatagattttcttttttttttttaatttttttttttctattatactctaagttttagggtacatgtgcacattgtgcaggttagttacatatgtatacatgtgccatgctggtgcgctgcacccactaaagtgtcatctagcattaggtatatctcccaatgctatccctcccccctcccccgaccccaccacagtctccagagtgtgttattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatggtgagcatttcttcatgtgttttttggctgcataaatgtcttcttttgagaagtgtctgttcatgtccttcgcccactttttgatggggttctttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctagattttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttgctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtttgcaaacagggacaatttgacttcctcttttcctaattgaataccctttatttccttctcctgcctgattgccctggccagaacttccaacactatgttgaataggagcggtgagagagggcatccctgtcttttgccagttttcaaagggaatgcttccagtttttgcccattcagtatgatattggctgtgggtttgtcatagatagctcttattattttgaaatacgtcccatcaatacctaatttattgagagtttttagcatgaaggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgattattgccacaatttcagagcctgttattggtctattcagagattcaacttcttcctggtttagtcttgggagagtgtatgtgtcgaggaatgtatccatttcttctagattttctgatttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcctgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcccggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccatgtgagatgtcagtgtgcccctgatggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaatcaagcctgggcaatggcgggcccccctcccccagcctcgttgccaccttgcagtttgatctcagactgctgtgctagcaatcagcgcgattccgtgggcgtaggaccctctgagccaggtgtgggatatagtctcgtggtgcgccgtttcttaagccggtctgaaaagcgcaatattccggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccctcagaacccaaatttttcaagtgcatagttaaatattttttctcttgacaagatttttttgatagagctgtttactcttctggtagagatgtagcttgagctattataaataaatacaaatagcatagatatggcattgtggtttcttgttaaacgtggtacctcaccaataaaaatatagcttacaatatttacatttgtgttaccactcactgatttgtatttgtatgcttatttcatagtaatttttcttgacagcatttattgttgaagaaggaagttcagggcacacctatgtgtgttctgacctggaaagtactaatagtcatattctttccatttctggaccttcttgtcttccagggtccttgttctgcatcccataaaagtccagggaccagtttcatctcttctcctcctctccttctctcccaagactaaccatctactgatgacacttgtgggctccatgttaaatttacttctttatgccttttaacttctgtcatgtgactcagcaacacatgccagaggttaaaggacactgcttgtagggcagaaagaaggggagcctctaacacagtgcttttttacaacttttccccctttctcttttaatgcattagccagaaaaatgataaggggtcatgaggggcctggacgtattccctgtaatcactgactatacaggctggccatttaggggtaaatgcttcagagaaggatattctttgtaaatcatgagattctctagggaggcaatgaatgtctcttgtttcactatctcattagagagaaagataaaatgcactttgcacaatccataatgatttatttttttctcttagacgcatcagaaaatatattaaagctaaaacattcttgctccttttcacatagattgcttgataaactaattgataaatccttttttttaaagtcagggtgtgaagatagatgtttaaaatggattgattttgattttttaaaatatcttaaggatataatacaatccatatatttcttaccactgaggactttttgttctataaagtaaatgtaactcatggtatcacttggaatttgatttaaaaatgcatttgaaagcagggatttttttccctattgctttagtttaatttttcagctttattaacaaacggaatgtaaattaatttcccaaagttaagtgtgtgtgtgggtatctcatgtgtatttggggaagctattactggcatgctttgcccagaagatagaactgtcagtaaacaactgacacactgttcggctaaatagtgaacatattctggagaatctttagcagcaaaatgtggacagttagattttgcttttcaacagaaacctgggaaagtgttgagctgaggggagagtctgagagaagtactattgatgagatcagggaggcattgtttccagttctaactattctagttctttgaaatgctttcccaatgggaattccttcccaatttccagggtcatcccaatgtttttaccacacacagcaccagcagccagtggccttcctgagccaggtgttgttccttctgacttccaaatccagtggataatggtgtcttttccccgtccctggctacatcttcctcagacagtaatgctactaagtactttgcctgttcaaatcatccatccgtggtagaggctgctgatatttcaggctggataacttgagtcctccctagtgaatctgatatccgagtcaaatcttctcatccttgtccacctttctttcttctgggccacaaatcaaaactctggagggtcttgtgagctcatatgtagtgcttcagtgcttctccagtgcaacagtggaagacacacctggctagtcacaccattgtgcttccaatcccatctcctctcattttctcagggactttgctcttgttgccatctcttctctgcactattgtttcttctctcctggataaatttcactgtaggacaaagaagggtgtattagtcagggttctctagagggataggactaataggttagatgtatatatgaaagggagtttattaaggagtattgactcacacgatcacaaggtgaagtcccacaataggttatctgcaagctgaggagcaaggaagccagactgagtccccaaacctcaaaagtagggaagctgacagtgcagccttcagtctgggccgaaggcccgagagcccctggcaaaccactggtttaagtccaagagtccaaaagctgaagaacttggagtccaatgttcgagggcaggaagcatccagcacgggagaaagatgaaggccaggagactcggccagtctagtctttccacattcttctgcctggtttattctagctgcgctgtcggctgattagatggtgtccacccagattgagggtgggtctgcctctcccagtccactggctcaaatgttaatctcctttagcaacacccttacagacacacccagaaacagtactttgcattcttcaatccaatcaagttgacactcaacgttagccatcacactagggtttaagaaaatgatggcaggtctaagcgagtcatggagggtttatgaaagatgggtcttggaaagggagttttgtgtataattgggttggctgggattccggaaaggaatttcagaatttagccctggtttcagggatacactgatgcaggaccagagcaacaagattttctcagaatattgatctacgcctagtaaaaacttgcaagaggatttgattttaattctgaaatcgatttctttatactttcaaccttcttctgaactacagctttttcatgttatacagtttctgcctaatttcaaattgaaagtgctgccttcttcatttaaaatgataatttcatttcttgagatagagttttgctcttaaagctttccagagtcatatctcaagagttcagctttttgccacgtctcacgacatacaatttgcaggtcatgcatcattgccttctgctcttcttccttctctccttgaaaaggtacattttctttttaactggagtggtgactctcactctcaactttttcatcagttcctgtggctgtttcccccccacccccagttctcaccctgttattgtgaccttccctttcccctttccctttccctctcccctcccctcccgtcccctcccctccctccctccctccctccctccctccctgcctccctccctcccttccttccttccttccttccttccttgcttccttccttccttccttccttgacagggtcttgctgtgtcacccaggctggagtgcagtcatgtgttcatagctcactgcagccttgacctcctgggctcaaaggatcctctcactttagtgtcctaagtagctgagattaaagacggatgctgccacacctggctttggcttttcttgatgtgtctaaattgttccatgtaaccaggcaatttcatgtgtctttaatttttctaaaagccatgcattccactgctcaaggtactggtttccttgtttacattattcttctataatgtggtatatactcatgaccttcgacacatacttttccagtgtctaattgaattcaaatactgtttcatcaggttcgacttacagtttatctaaatgagattcccaaaggaagaagtactcataccgtaggaggtttttctttgccttttcagtaaatggcctgggaaacagaactttcatgttttattaagaatttatggtgctttgtgctgtctttattagctttttgattatttagaaaaactgcatcatctttaataagtgatgttcatctttaaaaaattatatgtgtgcggatgtgtttatatgaatattctaaaaactacgtaaactgtataagagtctgatggtcttggtatgatgctgtaaatcatgattctggttgttatcttaaaatacggtacacaggccgggtgcggtggcttacacctgtaatcccagcactttgggaggccgtggcaggcagatcccgaggtcaggagatcgagaccagccagaccaacatggtgaaaccccgtctctactaaaatacagaaaattagctgggcgtggtggcgggcacctgtattcccagctactcaggaggctgaggcaggagaatggtgtgaacccgggaggcggagcttgtagtgagccgagatcacgccactgcacttcagcctgggcgacagagcgagactccatctcaaaaaaaaaaaaaagtactgtacacaatagaagtaactaaatttccttgttaattgtttgttacaatgaattctcatcaaatttttaaccacagctattctaaatttttgtcatccacagttttgatttttctcataaagtcatctgcagtcagattcatggaaaagactctaataagtagccttgaatacatgtttctgataacttaaaaatcaatggattaagtacaaatttccaaaagtctaattaaaataactgacatattcatgaaactgctaaccaagatcaaacagagcaacagttaattacatgggactaaactgataatggattataatttttatgacttttatttaaaatattgctaattctttaatattttattttccagatttaaggaaacttttttcttaaggtacctatagcaatttggttatgtatactcttgtgaataatattaaaatgtttgctttttctccctatcttatctctctaaaattaaaaaaaactattcgtgagtattttttattttatgacaatgtatttacataattttgataaaaatttattttttaaataacaagatacaatttaaaatgttaattatattagcaaggtttgacttagacatcatatttaaaaattcttgtaggtacttcggatacaatctgaagcccaccttgatttggccttcttgcttcagaagttaaaaaaaaaagttcaatctgagattcaatcactattctcactgtacttatgtaaatactcaggacaaatctgataaaactaacttattttacatacaaattagtcttgctctgagtactttggtaaaattgggatgacagtgatataccctttattagattgtagtcttgtgagttgttttcaggttttattatatacttgtagaagggactggatcttaaattcttctaggttcctctaatccaattttctcctatggaatttttaaatagaattactaacaatggaaaccattcttttctaaagcgctgtaagctaaaactaaacatcttaatataaattacaagggacaagccttgtgcctgatatgtgggccacacagaaagttcaccaaaccgcctgatgccatagtcagaggcattcagactgcaaaactgctgacttcacactgtggacagtgtttcccaaggccgttggaacaagacatcataatgagattcttaccccttgtaatgcctcccttcttcacttgacaggataatgccataattaaaatttcacaatcagtaacaattatgagtaacttaacaaaagctgatctaagaaatcccttagtccacttattgagtagctttggcaatatccctaacaactttttgttcatattgtactagtgggcccttttacagagttagcactgtctgctttaatttaacccagtcatggaatactacccaatggctatgccaagtcttacccagtttctccatggtcttttgatttgtttagttgattgcccttaggcttggcagaactattgcataaactagatttgtcatactcctgttgtttttactttgtattttccttttaaaaatatgtacctgatgtctgtcaaatttctgcagaaatgcaacttctaatagagtaatgtttgtctagtgtcttaaaatgatagccaacatcaatggaacagacaaaaatcaaacttgatgacatccagacaaacaaagcctgagagcttctccttatggccttcttgttgctcaaatgtggctaaaatggcttgatactgacttccagctgataatcacctgcccctgatgttgtataagaatatctatccaggacaggtccatcctagcacccagggatattcaaaacctgaatacaggctgatcaatctttctccaaagaaagatcttgattaaaagggggaaacgtgaaagttgcagatatgaggataaagtcagttctgtcagactcaaatttgagtcagggaagcatgaaggggaagggctcatgcttgcatatccgagataaggctatctcaaggactttctaaaataactccacaagaaattccttcacagctttcacatatctcattcttttcatgacttaacgttctgcacatatgcatacatttctaggaccaggtttatcattagacattctttagaactgtagcaattcagataagatgctcttgaaagaacccttgcctagtaatggcatctccaccaatgaactgacgctgactctggctttgagcttctggaaaaaatgaactctttccaagcagcttacatgagcttatcctttttgtcaataaaagcttcctcttaccatctcctctttgggtgtatctgtggctttactatagctgtgctatggtgagattacattatagtaaggttatattatagtctgggcagattataatatagtataatttgtgcccagattatagttctttttacttactcttggaaaaatacattaaattaggagataattttctctgatgtcttttttagcttgatgccatcagcatgcagacatcctctctagtatctcctgtcttgaaaaaggaaaggaggaaaacctcctttgatcttaggtccctcttcacccctgtcctatttaaatatttgaggaagttatttgttgtcccatgtctgctttctttctttctttttttttttttttttttgagacagagtcttgctctgtcacccaggctggagtgcagtggcacgatattggctcactgcaacctctgcctcccgggttcaagcgattctccagcctcagcctccctagtagttgagactacagttgtgcgccactggctaattttgtatttttagtagagatggggtttcaccatgttggccaggctggtctcaaactcctgacctcaggtgatccgcccgcctcggcctcccaaagtgctgggattacaggcctgagccaccgcgccaggccctctgctttcttatctattgtcttctcaacctattcaaattggctttcttttcttgtgctctgagaccatgcttgcctaggtcttgagtgacctccacattgtcaaatctcatggtcacttctccatctgagctctcaacagcatttgacccagtggactattctctgcttacaacaccttctgtacttgctcagatttcctctggaatcactagctgttccttcaggtgtcttttaatgggtccttctcatgcccttgactgtaaatcctggaataccccaggccctggcttgggtactttctcttttctaactttgcatgctcccaaggtagcttcctcagctgcagatttacacaaaatctatacattgatttctctctaaattatatttctagcccagatgcttctcctggatacagacacacaaatctaagtgcctgcatcacctctctccttggatatttaaaaaatctcaaatttaagatgttcaaatgtgaactcttaattatctctaccccaaactgtttttctacttgtgatctcttaagcaaaacaaaacaaaccaaagtaaaacaaaaaccaggactcatccttgacatttctttcccttattcccaattcatcagcaagcctttcctcttggttctactttcaaaatacaaccgtttgcttttctccatctctgctactatcaccttggtcctggccatcatttcttgcccccatgattgtagtagcctcctaaccaatttccagaccagctacaattcatttgcccacaatggccaggatactgttttaaaaaatgtatctcgggccagtgcagtggctcacacctgtaatcctttagaactttaggaggccaaacatgtatacatatgtaacaaacctgcacattgtgcacatgtaccctagaacttaaagtataataataataataataataataataataataataacagcaataaaaacagctcatgtgggaaaaaaaaaagaactttaggaggccaaggagggcgaatcacctgaggtcaggagttggagaccagcctggccaacgtggtgaaaccccgtctctactaaacataaaaaaattagctgggcatggtggtgtgtgtctgtaatctcagctactctagaggctgaggtaggagactgtcttgaacccaggaggcagaggttgcagtgagccaagattgcaccactgcactccagcctgggtgacagagcaagactctgtctcaaaataaataaataaataaaaaagtaaaaaataaaaacatgtatctcagaccatgtcattcttctgcttgcatgtcttcagtggcttccagttgaatttaaaataaaacctaagcttcctcttcgggcctgtgaaacctcacttgacttggcctctcccactcctctcctgaggatgtttagccgctttttgctcccttggtattctaagaaaggtcattctatcttggggcctttgtggtagctgttcccttagcctagcatgcttttccccttgatccttgcaaagtagttccttcttgtcattcacatcatagcacagattaaggtctccttttaagagagggcttccctggctattcaattcaaatagacatttaccctttcttgtctgttatccagttgggtggattattttttcctatcacaaatattttaatattttcgatattttgataattgtttttcaatataattgtgttcctttattctatgtgcttttaattaaacattttattttgaggtaattgcagattcacatgcaattataagaaataataccaatctcttgtatcctttattcagtttcccccagtgataacactatgaaaaactattgtacatatcacaactaggatgtttatgttgatacagtcaggatatagaacaggtccactaccacaaagatcccctgtgtcaccctttatagccatacccacttccttcctgcctccattccctccttaacccctggcaactactatttttttcttcatttctataattttgtcattgcaggaatattatataaatggaatcatacagtctgtgaccttttctgaatggcttaaagtgtcagcgtaatactatattcacccaggttgttgtgtatatcaatagtttgttcctttttattgctgagtagtaatccatggtatggatgtatcacagtttgttcaaccattaacatgtggaaggactttgggattgcttccagtttggggttattatgaataaagctgctataaatatttatgcacagattttcctgtgaatgtaagtgtgtgtttctctggcgtaaatgtccaggagtgcaattgttagaatatatatatatatatggggaaaggcatgctaggctaagggaacagcaatcacaaaggccccaagatggaaacacccacccaactggagatatatgtatataaaatctaacattgtactcctggacatttatcccagaggaaaggtactactttgcaggtatcaaggggaaaggcatgctacgctgaatctgtttaggtttttaagaaactatcaacctcttttccagagtggctgtaccatattacattcccaagagttatgtgtgacagtttcaatttctccacatcctctccaccatttattgtcattctttttaattttagcctttctgttagatgtggagggatatgtcattgtggttttaatttgcgtttccctaattgcttgtgatgttgaatagctttgcatatgcttattggctttaagtatctcctcttatggaaaatgtctgttcatatctttagcctgttttctaattgggtttttaaaaaactgttgagttgtgaattctttatatattatagatattagtcctctgttggatatgtgtttgcaaatgttttctaccagtttgtagcttgtcttttcatcctcttgaatcagatcttttacagagcaaaagttttacattttgatgaagtccaatttaagaatttctccacatatggatcatacttttggagtctaagaactcttgcttagtcagagatcatgaagattttctcctatgtctatttctgaaagttatatagttttatgttttacattttagtctgtaatccattttgaattaatttttttaataaagtgtgagacttaggttgttttctttgcctgtggatgtctacttactccagtaccacgtgttgcaaaggctatccctcctccgttgaattgcttttgcatctttgtcaaaatcaactgagcatatttgtgtgggtctactcatgccttgcctattctgttccattgacctgtatatctgtcccttggccagtactatccagtcttgatgactgtagctatattctaagtcttgtatcaggtagactgacttgtcccacattattctttttcagaattgttttagctattctagttattttgtcttttcgtataaattttagaatactcttgtctatataaaaaaatcttgctggagttttgataggaattgcgttaaacctgtatatccatttggaaagcattgatgaacattgatatgtttcctgttgtaagtcttctaatcaatggatatggtgtatctctgtgtgtattttgctctttgatttctctcatcagcattttgtagttgtcagcacatagatcgtgtgcatgttttattaaatttgtagctaagtattcatgccttttttttagtgattgtaaaaggtattgtattttcttttctttttttattttatttttttgagacggagtctctctctgtcacccaggctagagtgcagtggcacaatcttggctcactgcaagctctgcctcccgggttgacgccattctcctgcctcagcctcccgagtagctgggactacaggtgcccgccaccacgcccagctaattttctgttatatttttagtagagacagggtttcaccatgttagccaggatggtctcgatctcctgaccttgtgatctgcccgccttggcctcccaaagtgctgggattacaggcatgagccactgcgccctgccaggtattgtatattcaatgtaggtgtccatgtatttattgctagtgtatgaagatataattgtttttgtacgtttatcttgtatcctgtgaccttgcagaacttatttattagttctaggagtttttgtttttgttttttagattccttgggattttctatgtaaacaattatgtcatctgtgaatagggacacttttatttcttcctttccaatctgtaggctatttattttcttgccttatttcactgtctagaacttccagcattatttgaataagagtagtgagagttgacatccttgccttgttccccatcttgggaggaaattattcaatctttcactattaagtgtagtgttcactgtaggatttttgtagatgctcttaaccacagtgaggaaatttccctgtatttctacttttctgaatttttatcatgaatgagtattgagttttgtcaaatgtgcatcagttgatatgatcatgtaatttttcttctttagcctgttaatgtggcagattgcattaattgattttcaaaaactgaaccagcaaaacccacttggtcatgatgtataattttttaaagatactgatcaattctgtttgctaacgttttattgtatttttttggtgtctatatccatgagggatattggtctttagtagtgttttttttttttttttgtaatttgtctagttttggtaccttaataaaattaactgggaaatgttctttcctgttctgttttctgaaggagattgtgtagaattggtattaattctttagacaattcagagaattttccagtaaaaccatctaggcctggtgatttctcatttgggaaatttcaaattacacgtttaatgtccttaatagtgatatagtgttattcaaattatctgttttttatcgagtgagttttattagtttgtgtttttcaaggaattggttcatttcaattaagtgatcagttttaggcatgagagttatttatagtattcccttattattgttttgttgtctgcagggctatagtaatatctcatctttcattcctgataatggtaatttttgtcttctctttttctttttcagtcctggtaaaggtttgtcagttttattgatcttttcaaagaactagccctttgttttattttctcaattgttttgttcttttcaatttcgttgatttctgcccttatccttattattttcttccttctgcttccttagtttatttgcatattttccttccacaccaggttcttgagggaaatgagattattgatttgagaccttttctgtcttctaaggtacaaagttagtgctatattctttccttttatctcacttcagttgtgcctcactaattgtgatatgttgtagtttaattttcattcaattcaatgtatttttgacttcccttcagactttttctttgatccatgtatcatttagaagtttgtttttttagtttccaagtgtttgggatttttcttgttattgatttctactttgatttcattgtcattatagaacactttctgtatgatttcagttcttttaaatttgttgaggtttatctgatggctcaggatatggtctatcttggtatatgttctgtgggtacattaaaacgatgtgtatctgctgttgttgagtggagtgttccaaataaattatctaaatattgattagctctttttggttgatagtgttactgagttcttctatatccttactgattttctgtctagttctattaattgttgagataagtctccaactataattatggatttgtctcccttctttcattgctaccagttttgctttacataatttgcagctctgctgtttggtgcctacacatttaggattgctatgtctacttggtgcactcactcttttactatcatataatgttcctgtctctgataattttctttcctctgaagtctactttatctgatattaatatagccagtcctactttctttttcttttctcctgttttctttggattaatgctcgcataatatatacattttttgactttcaacctgcctatattgctatatttgaagttttttgtttatttgtttttttgagatggagtctcactctgtcacccaggctggagcacagcggcgtgatctcagctcactgcaacctctgcctcctgggttcaagtgattctcctgcctcagcctcccaagtagctgggattacaggcatgcgccaccacgtctggctaatttttgtatttttagtagagatagggttttgccacgttggccaggggttggtctccaactcctgacctcaagttatctgcccaccttggcctctcaaagtgctgggattacagacatgagccactgagcctggcctgaagtttgttttttatagacagcatatagttaggttatgctttttaatctactctacctgtcttccttttaactggtgcatgtagaccacttacatttaatgtaattacttatatgttagcgctaaaggctgccattttattttgggggtatttgtttgttactctgtttttaatttattttcttttctttcctgtattcctgtgtgttaggtgaaattttttagtattccattttggtttatatagtgtttttgagtacacctctttgtactgcagttgtcgtggctgttcacatgtgtgtgtatacatacacacacacgttatcaaagtctactgatgtcatcattttaccagttcaagtgaagtgtagaaaactaacctccctttgtcttccattggccttccctatttataatataatttcattaaatatttcttctatatacatttagaaacacattagacagtattatagttgggctttaaccatcaaatatagtttagaatacttatggaaaggagtctattatgtttacccatatttttgcttatcatgtacttttttcttttctgatgttccaagattctgttttttattgtttcttttagtttagagaactttctttagcccttcttttagggttggtctgctggtaacaaattctcttagttttccttcatctgaggatatcttgatttctccttcatttctgaggatatttactttggatataagattctgggttgatggttcttttctttaagcaactgaaaaatattctgccactttctcctggcttttgtaaggttaaattaaataagcaggaggttattaccttgaggctgttttcattctttgagtttctacctaatgaaccacaaccaaacagtatgtaaacaaattaaaagctaacttagaactataacaaacagccaagtttcagccagtcacaggcagctagctgatcagactatgcccaaataaggcaaatacctcatcataccaggctttaataaagcagatgcctagctgtagccaatccagtgatttcatgactttgcttctgtgtctggcctataaaagttcacttctcatactaccggacacaggtctctgaacctcttctggttctgagtgctgcctgattcatgaattgccctttgctcaaataaacttgattaaatttgtctacagtgtttcatttaacagtgatttctggtgagaaatctgctgtaattcaaattgtttttctctataggttaagtgtcatttctctcactggtttcaagatattttttctttgtctttagattttagaagcttgactatgatgtgtcttggtgtggatttcttttcttttcttttttttttgagacagagtctcgctcttgtcactcaggctggagtgcagtggtgccatctcagctcactgcaacctctgcctctcaggttcaagtgattctcctgcctcagcctcctgagtagctgggattacaggtgcccaccaccacacctggctaatttttgtacttttagtagagatggggtttcgccatgttggccaggctcatctcgaactcctgacctcaggtgatccgcctgcctcagcctcccaaagtgctgggattacaggcgtgagccactgtgcccggctggatttcttgctttatcctgtttggcatttacttagcttcttggatctgtaggctgtcttttgccaaatttggaaagttttcaaccactgtttctttgagtgctttaccagtcctgccttcttttcccttctcttattggaacgctgatgacatgaatgttaggtcctttgttatggtccctcatgtccctgcagctttgttctttgtcttatttttttcctgcagtttattttctctctgttgttcagattgggtaattttcattgttctatcttccagttcacattttttttctctgtttctgcattctgtgggtgagatataggctaatttttaatttcagttattttatttttcagttctaaaatttccatttagctcttcttcatatgttccatttctttgctaagactttctatttttcactgcttctagcatcttcacagtggcttcttggcttctttagaatctttgtcagataattttaatggttctgtgatcttggtgttggcatctactgattgtcttttctcattcaactagaaatcttcctgggtcttggcatgattattgttttattaaaatctgggcatttggggctatgatattatgagactctggatcttaattacattgtctggttttgcttgttttctttgacattgctctggtaggggacatggggggcactgccttgttacttccaggtgggggaagtctcctctcagacttcactgacactcaaggtggggtctcattattgctgagggggagcgagagttccggccattaggcctccactgataacaaagcactcctacccttctctggttgggaggggtatgagtgccttgttactgctctgcacttggcctcaactgacaccatggcgggggcagcctcattaccaccaggtagttctgactctccactaggcatcctctgacatcaccccagtggggaggagcaagggcacctcatttctgctgatggaggcgaaagttcaggctccccacatgctgtccactaccaccaaaggtgggtgggggggtgggtgggtgttgttactgccttatgggtctacttggccttctctgacactgccccaggggtgaggaggggagagggctattggttacctcatttcagcctggcaagggtagaagtctaggcccccattcatcctttgctggtgtggataagggtacggccacattttgttttctctgtggtctgtggctggagtagagcagttattgtctaaaagttttctttcttccttggctgccccttgcttggtcccttggctagagagagcagacatttgcttggtcccttggctagagagagcagacatttgttggggcttttttttttttctgagacagagtctcgctctgtcgcccaggttggagtgcagtggcacgatcttggctcaccacaagctccgccttctgggttcacgccattctcctgcctcagcctcccgagtagctgggacgacaggcacccgccaccacgtccggctaattttttgtatttttagtagagacggggtttcaccgtgttagccaggatggtctcgatctcctgacctcgtgatctgcccgcctgggcctcccaaagtgctgggattacagacgtgagccaccgcgcccggcctgttggggcttttttttttttttatgtccatgcgcatttccgtgttgctggcttcttcagctccaaatcttggacacgtgagggaaaaagaaaactgagagaacccatgaccttgtcctttcttgggtcccagggtcccaagctggtgtgccttcttctctccacctttcagagtcttcttatgtttgtgttctatataatgcccggggttttaaattgtagttagtgtgaggaatagagaaaagtatatctaccccatcatccctgaagcagaagtcctctgtgctacccaattttaaatcccttcttagcggatgttactgtctgataatctcttgtcctgtttatccctatggtatcccaagtccctcaaacactgcctggcacatagtagttgtgtagtaattatatgctaaatgtcgaatgaacattcagcaggtagcgatgatggtgaattggggcctgaatgtcctgcttctgtttaccttcagcctgttctttgcctagatcctcttgatttttttggagggaggatgctaaaaatccagattttatatgaaatgtcctacttttgaaatattggcaattaatttaattttttaaaaagctgtgcaggccaaagaaatgtgtgtgattaattattatgatccactgccaaatggctggcactttttttttttcagagtcttaggtaagcgtatattgcttggatagttcatctgcaggttgcctttttctcagtttttgaatagtggaaggatgttacctgctcacccatagcttggccagtatttgctcaggagctgcatatggtctctgtagagataactcctggctttttgtctgaggatgttcctgtaaaccttattgggaggcagattgggtagtaatgaactgagcgcttgcccatgtgctgttgtgttaatccgttgaaggagcttggctggcagaatgtgagagctctggcatgatcggggataaggacagaaagctgtcaagtcatgatacagatttgacgatgctgggtgggcagagcagcagaaggcaggctttgaaatgggtgggcagcctcacaagtgggctgagcaaaggctggcaagaaatgaggtggagggagtgctttgcttgtagtgacctatttaggaatcttttgagaacaggatgcaagaataggtattctctcgaatgttataaggcagatataatccccttcttggtggtctcattgagccttagctcaatgtaaaagtgatgcatcttaaaacctattttaataaattttatataaatataactatatataaaaaactataattttatataaaaattcgttttaaaaaagttaactaggctgggcacagtggctcacgcctgtaatccaagcactttgggaggccaaggcaggcagatcacatgaggccaggagttcgagaccagcttcgccaacatagtaaaaccctgtctctactaaaaatataaaaaattaaccgggcggggtgttgcgtgcctgtaatcccagctactcgggaggccgagacaggagaatcgtttgaacctgggagacaaagatttcagtgagccaagatcacgccactgtactccagcctgggtgaccgagtgagcttctgtctcaataaataaatcaataaataaaataaaataaaaaataaaaagttaactagcattcctgaattttacccatcctggatctctgctattcacattggtgtcaccaagtgcattttccaagaaaagacagtcattgcctaaaacaaattgtcacctgttgtattgaaattattttggttacttcctgtgcctgtctaccagatactgcttatacaagtcttgaggaatgcttgctgagtgaatgaatgcttgcattcttttctcatgacttcgcacttacagcgcacagaaatctgaggtctgtagactcctggttgctgaagagttgggatgttgcaccaaaattaaaattttctttattgtattagtctttgactttaactctggcatctactttgtttggagctttgtcttttataaataaataattaggagtaaggatttctaaacattttatcttcatatccaggacaaatgttttgcagttagttaatcaaccattacgtgagtattgatcataatactaattagatttattttgcagatgtggtggatgctatacaaagtgttttagtggaaaggtctcatttaatcctcataactatcaaaaaatagtataaacagtcaaatagtatgtcaaatagtataactagcaaaaagtagattaaaatagtattatttttatcctccttctacgaaggagggaattgaggcttggcaaggtcaagtaaaatttgctgaagtttatacagttggaaagtgatcttcccaggactcaagagcaggcttgtgtgattccaaggcaagtacagtacagtatttgttaccatcgcatgagataaatatttgtgtttgtatttgtcaccattgcatgaaataaatctgttgctaattctctaaccttttctccatgattctgaatccttatataaatttgaggtgctttcatcattcattggagccagatgtcacctgtttacactctgtattacatagaatattctaaaacaggggttggcaaacatttggcctgtgggccagatatggcccactgcctgttttattgtacagcttgtgagctaagaatggtttttataatttcttctaatggttgaaaaaaatcaaaagaataaaaatatttaaaacatgtgataattacatgaaattcagatttcagtgttcatacataaagttctattggaacacagccatgctcatttacctacttgttgtctctggctgcttttgtattacaagggcagagttgagtagttgtaacaagagactgcatggagggcaaagcctgaaatactactatgtggtccctacaaagaagtttgccaacagtttttctggactataagtctgggcaattgaagtatggcggtatgcatgtttctgaagccctggatagaacactagaagcgttttgtctgaatatgcagtttggttgtgcatttttggaggatccccaatgctcaacagttctttttcatcctggtgacctggggagggcctcactctggaatacattcttactttgtagttcaggagctacaagtaccaaaaagtcacctctgctaatgccttacttggccatcacacaccaaactcttctatccagatattatagtactggggaagaatgactgtggtatgtttgcttggatggggactctcatttacttggagggaggaactcaagaagcatttttgggttgcaggttgtctggcattttgctgtgcatttcattgtaatttctcaccagggaaacactgcttgctctcctggctgggtttacttcatttctatcatcttttctttcttgttttaataattccaacttcatcttgccttctcctttgcttcattttgaaagagtcccagtttgcttttcttgccaattctctacttacttttcccagagctcaaaaattattcttgggggtgatgtcattttcatgtttatctttcttctctcacatgacttaatcaaataagtatgtagattataatttgtgagctgtgttctgagggaattaattgatcatcatcatattcttttaaaaggactgtggccagttttagcctcggttaacttcagtcagtttgtacaatagtaatggaatgttttggcgtctattggagcaggcgtggaccatatatgttctataggcttttcagaaattctatgcagaaattatgtgaaccagatggtacccttttgatttgccagacatgcatacttaaagaaatgtggggcatttattctccttaggagacttagagggggttctttgggaatgtaaatcagccaaaattgtcctaattgaaaaattctttggagtttgtcatcaaaataaggagtgtactatcagaagaccgcatagattttgcgggaacaaatattactggatttatttgatttacttctctgagaatgaaaagccccatagacttaggtaaaagaggatataatccatgagatgcttttattttgatagggccatggatttgctcacttaggcctctttggggacactttcagcagtgagagtatgtggatgtgaggtgggtgagggagatggcatgggtcccagggaatgaacagacagtgagggccagttcattaaaccgaaagctgaagggacagggtctagtcattctgagaagaccagactttaggggaacttgcagatcattgcaggggcttaacctacgggagggcaactgttagatttcctctgagcaggtagaaggtgtacatgagtcatagttacatctaagcacagagatttgggattcagcaaggattgcagaggaggagatagtgtctttcttcaggtaatatgaagagcacagtggaactggaagccccagccagatagggagagctgagtctggttggctgtctgcactggcacttgctggggactttggggaaatgtctttcagtgcttcagtttccttatctgcaaattggagttaatacctcaaagggctgatgggtttgtgccgcttacaaattatttggctcaattctaacttgtaatgttgtgctgaagcttagaaattatgtatctcaagtgctttatatatgatatatggtttaattaatgggagctttagtatagtaatcatttagtatactggttaagagttgagttcagaatcagagagacctggctggagtcgcagctcagccattttggtagctgtgtgatggtgaacgagtcacatatcctatgtaagcctcactctcctcttccgtatactagggtaaagagcagctccaacacggtggactcaactttggggattaaatgagctaatgcacatgaggtgctcagcacagggcttggcccataataaacgtgtaataaatgctagctgataactttctccactgacctcctgcctggaacagaaaatgaaattctgcttcttaaaaccaaatgttataagcttcatccttataaaccaactgcctttagaaatgtcctctttctactcttctctgggttcctggggagcagaacgcctgcttgggtgatgacttatgtctctcaaatcctctctacccctccatgatatcacacatttccgtcgtacggcatgtactaaggtctgcacttaatttatgatgtaagggccaggtgcgtattttcagccttcaaaggctgagtatatttgggattgactctgaagggggaatcccctgttgtttcattcatacagtaggtatagcctgatggttagagtgtgggttagtatatctgggctgcgtagcttgctttcttggttggcactccactgtaagcagacctcgatttgtgtagaggtagagcgtgtgcatgtgtgtgtgtgtgtgtgtggtgttgatgttgttgttcttgcagtgatcccgggaaaactagctggtgagtagggagagtgacggggaggagatggaagccaatcaaggtgcactattaatcaagttagttaccatggatggtaactggagctcattcttcctagggaactctcacagacagcatagaagccacctgagagttatcccagcaaaggcaggaagctgggggatttatctaccaactgccctgcccatcattggctgaggactgtttctgggacgttaagtccctggcacttccaatttgcctggcacatgggctaatgttcctttggttgggggtaaaaaggcctccagactgaaggttgcaggtgtttgtggtaacagacttgatcttgtagaattgagtcctcggggccatcagtggggcactgacagcatctgctctcctgtctaaggtggaaggctgtctctgccacctaccagctctgtgatcttggccacactacttattatgcctgagtttcctcatctgtaaaatgaagataataataatacctccttcccagacttgtgatgggaatgaattgaactgatatgtgtaaggcacttggtagaatgcttgccatgtcgtaattgctaaataaatgctaacttttattattttgtgattattcattgagtttcttcaggttctttttcagtgtaataaaattcaccatgtttactgtgacataagatgaagattttttggatggaaactaattagttgtttctttgggcatcagattatttccccaatttttatttatttgaaaactgttacaacaaaaacgcaatctgttttagggttaaaaaaatcctctttaactctatcacccttcaattattacttttatctttttgttcctttggagtctgttgatataaattcatatttctacactgttataataaataatggcaaaactcagtttttatcactgtttgttctaaaaataaaatagcaaccctgtacccagcatactttacaggttttttaaagttctcacagtttatgaagaagatgccgccatcccaatttcacagatgagaaaactgaggcatgcagacattatgcaactcttttcaaatcacacagttgttaccttgtggggccagcatgagcctgggaggattgcaaggctcgggcctcccctctgctctgtgtctctcacggtggctgaggtagaatacagcttggaagttcagccagcccttagtatccatgggttccacatttgtggagtcaaccaaaagaaggtcagaaaaatttgagaaaaacaccaaaacatctggattgaacatgtgcagactttttcttgtcatcattccctaaacaatacagaataacaactatttatttagcatttacattatattagctattataagtaatctggagacaatttaaagtgctgtatatgcaaaaatgtgcatagattatatgcaaatatgactccattttacatcagaggcttgaccattcaaggatttgtgtatcccatgggagtcctggaaccattcccccatggataccgaggggtagctgtacatttattggtgcctgccttcttgcctggtgcctgtttgttctttttggattaagagaaataattcctggctgtgcacggtggctcacacctgtaatcccagcactttgggaggccgaggcgggcggatcacctgaggttaggagttcgagaccaggctggccaacatggcgaaacttcctctctactgaaaatacaaaaattagcgggcgtggtggcagccacctatattcccagctagtcgggaggctgaagcaggagaatcgcttgaacccgggaggcggaggtttctgtgagccgagatcctgccactgcactccagcctgggggatagagagacattctgtctcaaaaaaaaaaaaaaaaaagagaaataattcctgtcacagggagcggaaacatgctgaaataattatttgctgaaattgttttccaacagatggctttaggaatcaggagatttgacactaggacgttaggtgggcaatggatttctagtaatttgtcagctttgttttattgaggtggagctgcatttaaattgctacttctccctgctggtttggtttggttctcctcagaaatggcttactttatttgtacttgacttgagttacattaaagcaggcaaaaatatttcttaagagctgaaatttcaggttggcaaaaggaaacaatgcaatctttaatcatatatctgaaagagcacagtggtgcattatgatggcagaacttcattccctaaccctgtacaaaggtttttagagactaaaggattgatcgtttttttcccctgacaaaacacctcttttgacatgtgcagagaaatatgtaatttgggttgcattgaaagaaagctactcttgctatttctctctccaagaggctgtgctcttggagttaatattttctactggagacagttctacttgaaaggcaaatattacaaaaaaccactagagaggcattgaaatctgttgtgggaaggagtcattttaaattttcttattaaaagaagatggcactaaagaggggggagtcatttccaatttattacttaacagaaagatgagcaatttgtcctctcagcaatagtgttctgtcagataacctgtttgccatttccttgccaacactgggtcttgccattcatttgaaatgtttgctcttgtgatctattaaaaaatttgtatatattgattttacatatgtgctgatcatttgcatttcttttgtgaattgccttttgatattttccatttttaaattgtcattttcaaatttacctttatatatgaaatatattaatccatcatcatatatcttgtaatggtttatttagctgatcctttgtggttgttgcaagcttttttgtgtattgttttacagtttgcagtttttgtcacaaattaaatccattttttgggatataaagtaggctttactttttatatattctgttcttttctataccggtggaaatcttgttattaatgtatactgcctccttagggtttgttttccaaatctcttttctttctacaagcatattagtctgttgagccttcttaagtttttttttttttgattcaaagtgtcgctcttgttgcccaggctggagtgcaatggcgtgatctcggctcactgcagcctccacctcccaggttcaagcgattctcctgcctcagcctccggagtagctgggattacaggcgcgcaccaccacacccggctaactttttgtatttttagtagaggcgagttttcatcatggccagggtggtcttgaactcctaacctcaggtgatccacccacctcagcttcccagagtgctggaattacaagcatgaggcaccgcgctcggctgagccttcttaagttttgagagaattttcttaagtttgttttctaagtctctcatttggtttcctttgatacgcaagctagtttttctatgctataccatttttaatgtgaacagttccgttctaggaatagaaatcttgatctcaatttgtccttcttccagggggcaatgccatcaagaatccaacctggaaatcagaatcagtgcactgttttgacttttccttcccttgccttctgtgagtttgtttcttatggtcatacttactttgatttctccaattggttctcttattttaaatgactgagtttcttcatatgttggattattttctcctatgctcttcaaagaaagtggctctagtgtgtctagtttcagcaggtgagatatagtctgttgtcagcccagacagggtgagaagggagagcttcagattgatagtttagctttctgaaaggaaggttgcaaatggagggccttgctctagaccagtgcggcccagtgcaaactttctgtgctgatggaaatgttcttggatctgagctgcctggtatgatagccactcaccatgcatgactactgagcatttgaaatgtggctagtgcaagtgagatggatttctaaacttttatttacttttaattaatttttattaattaattaaaacataaatttaaatgaccacatgtggccagtggctatgtattagatagcacggtcatcatgaggacggcttcctgtgtgatttgtttactgttgtgttcccagccccagtacttgtcacacagtagacactcaatattcatagaaattaatggatgcagcaaggggaaatctctggtagggcttctttccttgctatgccaagagttccttttctttctgtgggtctgcccaaagttagagaagtcgcattaccctcatcagtaactaccacaagtgctgttggtaggggcatctgtaggattcccatccccatggccctttttatgtcctactgtgtgtgccagtctgaccagtgagatcaatccatccttgccttaggaattcctaagaatttcagaaatttctcaaagctgctgccaggaagttgggagttgtcctagtttgtaaagctgatctagatacttctcagttttatagtcctatggccattccagggagaatgttggtgctagagagaaaagaactgagatctgtgttttgaatcaagagcctattgtcatctttctgtgttttaatggcttactatatcttgatgcaaaagcttcagtgtttacgaggctccactactgattgtatctttcagcaatctcaaatgaccctctttaatcccattttctgccttcttcttatactcagaatgatacaaatattacccccaatttaattttttcctcacatttgccctcatcttttggtgtaatactatggtgttactttaaagggtttttaagaagcaggtaatttatgtttgaaccaattttgattgtctttgcctattatttattgaggaaatcgtactattgacacagtggtatgtctggtcatctgccatttcgttttccttgttttttgctttcagtcctgtctttacattatcattacatttacttttatcttgtacttttgtttggatcatagttatgccatttctaattctagtagtggatcctattaagtttttaaaaaatccatattaaatctatatttatgaaattgctgaagtcagtaaaaatagttttttttttcactctccctgatagacaatcccacatttctttattttggttgtttttttgtatctcttttcttttcttctatttcctgagacatttggcaatctaatctagaactattcaagtcagcatttcacaaataacctcagtgattttcttttgtgtctctcttcataatcctgttatgaattatgcatgcatttatattaaacttagttgatgctcactttgccattttgagttcttaggttttccagctctctctgacatgaagcacattttcaaatacgttcttcaagaagcatacaccatatgttttctgagactttgcatatttaaaacattttttttggttgccttctgttgcgaacaacaatgtgtcttaatttagtagttttaaagtcacaagtgtttaaatattaaaatgtagatattgatgcattatcttccaaaacctcctgttgggggtaaatattgaggccatcctgatttgtattcccttgcagataatctctctgtctcctattttctcacctttgaattctgatgactctttatgtgtccttgagactaaaaaatgtcaccagaacatgtctatcagtgaatctctttccattaattttgcttaatatatgatgaaccatgcaaactgaaatctgttttcaactgaggaaagtgtttttttctggtaagtgcttatttattgtttggatactatttgtgtgggttttattttgggatgaaatagttttacatgggttggatgtttcttctgtgttccttcatatattaatgtaggtgcctcaacaagtctggggaagaataatgaaaaagtgttgtgttctttgcgatgatttttgtttttaggtaattttttgctccatttttgaagtatttctcctctttttccattggctgcattttttagcattgtaaagtgtgtgaagtttatttattcatttatttttttgaggtggggtcttgctctgttgcccaggctagagtacagcagcatgatcatggctccctgcagcatccaccttccaggctcaagcaatcctcctgcctcagcctcccaagtcgctggaactacaggcgtatgccaccacacctagctagtttggtttttgttggcattttttttttatagagtcagggtctccctatgttgtccaggctggtctcgaactcctgggctcaagccatcctcccgccttggcctcccagagtgctgagattacaggcatgagccaccatgcctggccggaagtttactttttactgcctaccatgtggatttgtttttttaaatttctattatgaggaattttatacatacagaaaactaaagagaaaaatactatgaatacctctaccccatcacatagattaacaggtattaacattttgccatctttggtttatcttgttttattcctgaagcattttaacagaccacgtaacatttcattcccaatacttcagtatgcacatctgaaaaataagggcctttctcttaggcctttctctaaccatgctaccactatcacatctaacaatgattttttatgtcctccaatgcccagcctatattcaaatttctctaatattctccaaatgtcttttatggccagcctgtatgaatctggatctaaccaaagaccatacattgtatttgatagttatgtctcttatactgcttttttttaaattcaaatttacataacataaagttagccattttaagatgaataattcagtggcatttagtagtcacagtgttgtacaatgatcatctctatctagttccaaaacattttcatcaccccaaagtaaaacctcataccctttaagcagttactcctcatttcccaccccacccatctcctgggaatcactaattatcctctgcctctgtggatttacttattctggatattttatatgaatggaattgtacaatatgtgaccttttgtgttttgcttcttttacttagcacagtgtttttgatattcatccatattgtagcatgtatcagtactttattccttttcatggctgtataatattccattgtataaatataccataatttgtctattcatttatcctttgtggacatttgggtttttctcccttttggttattgggaatagtgttgcaatgaatacttaccctagtcagctcagactgctataacaaaatactggaaactgggtggcttaaataacagatgtttatttttcagttatggaggctgggaagtccaagatcaaggcactggaaaatttggctcttggaaagggcccgcttcctggcttgcagatggctaccttctccctgtgtcttcacatggcagagagagagagagagagcactctggcctctcttcctcttctttataagcacaccggccccatcatggggtccctacacttgtccctcttctaaacctgataacctccccaaagccctgcttccaaatacaaccacattaggagttagagcttcaacaaatgaatttgggaggacataaacattcagtccatacaatactcatgtgcaagtatttgcatcatattttcaattatttggggtatataccctgagtggaattgctgggttattcttaaatgttttaatcttgaagaatttttaaccggtttacctgttttttttttttttttatctttcttgttccttcttgttcttttcctgcaatgacatcaatttgataacatgactagttcagtcgtcccatcttttggcttggcctgattgtttcctcttgttcttcttcagtatgttcctctgtgccttgcatgtcttataatttgggtaccatgtttttattttctctgcagtctcttttttccgtctgtttactgtttgatatatttgcctcttctgtttggtatgtggactattttgggggaatgtgcccttattttctgttgtgaacccaaagaagtttctatactttcctgcaataaatctatgtgcaagaatgtttttgctcttttttttgaggaacggtttctgtcctcttgtgcttcaaattctggtcataggcatcagactgttgtgtttctccttccttatctgtgaatagacctagtgttggcacacagatgtgatacactggccatttgcagtgtaccactgaccctggcacaatgccttctcatatctgaggccaggggctgagctggtggcaccaccaatgggacattcctagtctgtggccccatcccaggaagctctttttggctgacatagtttttctcttctctcactatccatttttttttctttctttttttaattttcttttctttttcttttctttttttttttttcctgagacggagtcttgctctgtcgcctggctggagtgcagtggcgcgatctcagctcactgcaaccttcgcctcctgggttcaagtgattcccctgcctcagcctcccgagtagctgggattacaggcacatgccaccaagcccgtctaatttttttttgtattttagtagagatgggtttcaccatgttggccaatatggtctcgatctcctgacctcgtgatccgcctgcctcggcctcccagagtgctgggattacaggtgtgagccactgtgcccagcctcttctctcactatccgtttctgacaaatgaaaaaaatggatgtgggtcctgcagaacctgaggccagctctaaccagtctttcatggatgcatacacctgcctgcaggcgctgctcccaggtgaggaggttgcatgcctcagaatgcagttagcctgggcatctgtgcaccaggctgagttcttgcctaggagctgcagatgtgtgatgaatgcagaactaaagttattgaggagaccaagagacttgacctgggagtgcttatgtggtttggatgggattccttgaggcttttgtggaggagcagtccgtggagtcagggtgtccgtgggtcactgttagcccacatggtgctctttgtatgagttagaaaaatacgcctcttcctcgacacactttactttcatgcgggggaaaactctcctatcctgaattggttagagctggtgatttgacagccgcctgctggaaaattgtatgataagtacacaaatctgcttcaggagggtgtgctcccttccatgtggcacagttgtcaccccctgcccagctgcctctgcagccactttgggttttgtggctgatgttcactagccactgactatacatctgaatctcttcctgtcagtagaagatccttctgatttgggcatatggtcaactttttatttttcataactcttgctacccctttcctccatttttattagttttcatggggacttaagtgagcatccaggcaccgttgctgatctgtctccctgacccagaagaccatgttggcttttggacaaagatcctggatagttctgaagctatgatgctgtgcatcagggttgaatgggggtcctgagagtccagcattgcttgtgctagcagctcatagcagcttaacttgtgtagcagaatgggtgccttgtaatagatagccatctgcttttcagtttatggaaggcttcgtttcttctgacggcattctgacgggcaggtgttacatcttttgtgactcccaggttatgaggctggttcttgggtttgactctgggaatcatgctcattgatctgcttttcctaatcatgtcagtgaatacctacacgtgaagaaaactcaagctgcaccataaagctaaaggaagaaggtaaaaaccacctcaaatttccgtgatacaggaaaaactgctgtgaccctccacttctccatcctggtcccatttcctgtttccaccctcatccagtttgcttttccagaatctttactgcttcctttgatgggggtaacgactctccctaaccaccccacctcccgtgggaactgttaccccatccatagccagcatttgacagcccaagggcaggtttatgtatttgcaaacgacattattctcctataactaaaaatgtaaagatcctttcgtattaaatagtccagtgtccctagggcacagtgcttttggatttcagcctgcttctgctttgtgatcttgggaaagtcactaacccctctgggcctctatctctatttaaaaggaagaggctgaaccaaaatgccctttccaggtgaaagcaagtggggaagttagacctatttagggaatagagaacagcctgtgggacaggtttgtgcttattgttggtgcagtttagtaggaattgtcagaagccgatagatagatagatagatagatagatagatagatagatagatagatagataatagatagatagataatagatagatgattgatagatgatagatagatgacagatagatgatagattataaattgatgtttgatagatcaatagatagataaaagggaaccaaatactgtctctgtggcctgggcatttttgccaggcagggggaatcacatcgttggtgacagagttgtatggcccacagaggccagctaagagattgggagaaggttgttgaccttgtgtgggaaccaacctcagggggatggatgaggttggggccccttaggggtctccgctcttggcgtctggactccccttctctgtgggtctaagctggcttctttctgctgtgggattgtgttaacactgcccctttagtgattttgcgttttttttttttttttttccgctgaccctcattagcagaggttttgctcttacacactgcattgtcccagtgacttcttatatgccagtcactggtgggtaaatgccagagggacactgagggctcatcaggaggactcagcctcctctcagagaggaagccaaggtggccagattacaatttgttttttctggtaaatgtcatgggtaggaaatgttatttgtgagtctgaaatatccaccaagggcagagggtgctctgaagacaaacaggaattgagtgctcattttcttggccctgaagtgatgtgttgcctccgtgatgtcacagttggcccccctacaacctagttcagcctggcacagtatatgacggtggtcactggctttctatctgggcaggatagcacctgcacatcagggaaaacagaccaagctctcacaagggcaatatcatcctttggaatttgttcacttttaattacaggagcttttaagtgaataagaccattttcccaatgagcagtgtcataaacattgaggactctcttaaatcagaagatgaatgaatggatggaatctttgctgggataatatgcaatcaagctaataggtgccttacctggacctcccaacaggtaataaatgggaaaatgttaagggggagtggttggggaagaacagtaaacttggaaaagccattctcatcagcacagaagcactgaaagaaggtacagatcttcatggtgaaaagtgggaagccttgtattagcaaggagtgatgattgacaaagacctaaggtctaatgtctaatgtgtgctggggagagtccgagaatcctgtgggtacagagaaaagtaagacattagaagtccttatgtgtgttttggagacagagtccctaagctcacctggtcagtaagtgtctcttgcatgagtgaattggacagtgcggactccattctgcaaaaagcttgattggaggcaagtggaaaggaccttggaaaattaaccaaaatgcaatgaagctctttcctaaataccaatggctaaagaacttcaacatgtcagtgttgtatgaaatacttcattggactgaattgtcctctgaatttaatgttagcattccctcaagagtcttggctttctttttttgcctgcactgtctgcattacagtgcagtaaggcagacttttcttgtgaagtggtatggataagatttagaggatctgaacacctctctgctttggaattcgtggtagctaaagtgtaaatagattcacacatctgacattcaaagtcagaaattcacgtggtcttgcactgttctggtgtgcaagttggtttcagaaggggcttggtgtttgaaaggtgctgtaaggagtggaagaatcgatgccatcttcagatgtttgttccaagtcacaagcaaaccctgcttcaaatctgctggcaaggcctttgagtcacacagagcctgacttgttcactttgtgtttgtccagcttccatggcatgtggaagaagttggtcggcttgggaatatgctgaatcaagcaacataaccaaccaatgagagggggcttaagcttctttcaagccgggcaaacctttagttgttagaagcccatacttcctatgtggtggtataggaaggacacagacttacctgtaggtttcttgccaaaaaatagaattgcgatctgatcaatcttccaactatttatagaaagtacaggccaggcttggtggctcacgcctgtaaccccagcactttgggaggcctaggccggcagatcacgaggtcaggagatcaagaccatcctggccaacatggtgaaaccccgtctctactaaaaatacaaaaattagctgggtgtggtggcatgcgcctgtaatcccagctactcgggaggctgaggcaggagaattgcttgaacctgggaatcggaggttgcagtgagccaagatcgccactgtactgcagcctggtgacagagcaagactccctctcaaaaaaaaaaaaaaaaaaaaaaaaggaaggtatggacgataaggggttcatatcaaacaacactatgggaatgaagtccatcggatttagaatgtggaaatactaaaagatgccacaccacatttcttcagtaaatacatggaaaaaaaaaagacgggggaagtggtgttaatgaaagaaactttgaagggactgtggcagatgcaattgatgttctgcctaccttcactccacttctacctctatagcttgctggaggctgtgtgccaggaacacctgtgacgctttcccctagggcatttattctgtccccaaggttacacatggtaagcggagcagagtgcccgagaattaatggcctagagagttaatgtctctggaagcagtgcttagccaaagatgggtggaaagctggtggacaaataccccagcttccttccctctatcccccagggttgggaaaactctcagtggtgccccacactgttttccagagttgtccagagagactgagcttcatttgcccccagcagtaacgaaccctttgttggtggtcctcccactgtctcactttccggctcccctaccagtttcactggggtcacctcccagttaaaccatttgcactgaaatcattgccccagggtctgtttctgggggaaaccaaagtaggacagggacaaatcaatccatggaacaagtgaaccttatttccatctggattcaaacaacccatctgccaaaaggcatttatgagttaaatgtggaaacatgatcatagatgggatattagatgattttaaataatcgttctttaatttctttaggtttgattgttgtttcttggttatttttttaaaaaagagtgcttatctgctagagatccacattgcagtatttacaaatgagatgatacgatgtctgtggtttgctttaaaataatccagtggtggtggtggaggtggaggggcaccagggaggggatccggggactataaggtgggcaaaactttaataactgttgaagctgggtgatggggacatggcagttcattacagaggttttgtggtgtatttaaaatctttcatagtaaaatgttaaagaaaacaaaaaaaagcacatgtacacctttctggtctccctcctctgaggcaaaattaaatgatcctcttcccagccatgttaccgtgacacatcggctctgtcttggggatcagtggctcagcaagtgagtccttagtgtctcagttcatggccctcctccatgctggtggccttcacctcctccattgcatccatccatcccgtagccagactggagcctttggcatcacccagacctgcttttacctgagttcttaaattccatcctgtgagctcctgccctgagcgattcctctggttctattgcagcaactttccaatctgtaacccgccatgcaatcataacccacgtggtctcgactgttaagtaccagaactgctgggcgggagggagggtgagcctggagacagaggtcaggccaggttgtgggccttctcctgtaaagagtcttcagcaattctagtgggatatccaagaggttgttgtgactttggccttggccaaacaccccaggggtgttataattggggggtgggcagccactgggagaggaagtgccaccatggctgtaagtggaagaatagaaacttcaatcgggagggatccagtacaggaagagttcagttctcagggagagagggttggagaaagcctgagtcgttgttagggcattagccaaatggccaggacttttccagagggaagctgggatataatcaggaaactagggcaggaggctaattctgcatactggatgcatgggccaggttcaggtgggtctcctgcccaaggcttgccacaggtatgccaggctttgggtggcaggaggaatggcagagctcagccactggagggaatgagcctgtgcccatggggctagtttctgatgggctcggtcactggaacaggttgggtgagggtggccatggagaacctgcaggctgaagatcttttatatttggcttatttattgagaggtctcagctctgcacatacataggaattggttttatttttgctaatcactgctttccactgtgctgaagcaagttcttctctccttctgtggagtaggactcttgaggatcctttgaccagggccatatatttcctgtcatggttaagttttaaaacctttttatttctgtatgacttagtccccctttttttttttttgaggtgagtcttgctctgtcacccaggctggagtgcaatggtgtcatcttggctcactgcaacctctgcctcccgggttcaagcgattctcctgcctcaggctcctgagtagctgggacaacaggtgtgtgccaccgtgtccagctaatttttgtacttttagtagagatggggtttcaccatgttggccaggctggtctcgaactcctggcctcaagtgattcgcttgcctccgcctccccagtgtgctgggattacaggtgtgacccaccgcacctggccgctttttgtttttaaaatatcagtttccaacctgattgacagtttgtcctcaacagcatgggcagagatgggatcctggctgctggtagcggaagagggtgctgtggtcaggctctgtgcacctcctccctctcccccttccagatgctccttcccttggtgctgggcacaggaaggacaggtggagaggcttagttctatgtgtcttccacctgcagagggtgtatgggggttcctggtcttgctgtggtccccccggttctgtctgatgctggtgtggcacctgtgtcttcctgtggtctcatctgtggtatataatcccaccctcttttcctggtgctatttcccttacccttgaagctgcctggacaggccatggctcctctcctgctgctctcccaacctgaaccttcttgttgactcagggaaaccactggagtcttctttcataccctctgagggccatagagaatggtattccttcactgaaggcaactctagtctttgcaagtggttttcttggagtccctcggaactggctttgagaaagggaaagcatcctcatcagtttcccatgagaatgtgagggaataagaaaagtagctaataggccagatgtggtggctcatgcctgtaatctcagcattttgggaggctgaggtgggtgaatcacttgaggtcaggagttcaagaccaggctggccaaaatggtaaaaccctgtctctaccaaaaatacaaagaagttagctgggcgtggtgatgcacacctgaagtcctagctacttgggaggctgaggcaggagaattgcttgaacccaggaggcggaggttgcagtgagccaagattgcaccactgcactccagcctgggtgacagactgagactcggtctcaaaagaaaaaaaaatgttgcactaaacatctttttccatgttaaggttgtctgtctgtatttaggaatggactttccttatgatagactccactctgtgatgtgaaatttgtacatcaaaggatttgaacaattctaagtacaaatttttatatgtgtgtgtgtttgtgtgtgtgtatgtgtagtacagttttaattgctcccatgatacatagtcattagagaaaacccttgttaaaaaaaaaaggagcggggaggagaaaggaggcaaagaaacacgtatatggatttgcgtcttccatttgccttgaattaaatttaatgtcattaaaaaacccactggccaggtgcagtagctcatgcctgtaatcccagaactttgggaggccagggcgggaggatcacttgaggccaggagttggagaccagcctggccaacattgcaaaaccccctctactaaaaatacaaaaattagccaggcgtggtggtgcacgtgcctgtagtctcagctactcgggaggctgaggtgggagaattgcttgaacccaggaagtggaggttgcaatgagctgagattgtgccactgcactccagcctgggcaacagagtgagattatgtctcaaaaaaaaaaaaagaaaaaaaaaagaaaaatagctaatacttacatagtgcagttctaagaatgttaaatatttcaattgatttaatccttgtgataaccatttggagtagacattagcctcattttatggactagagtggatatatatagccctacatcacacggtttataagttggcagatccaggacttgaaccttgtctttcgggcttaggtgttacatgtcactcttgtcacgctgaagggtccttcttttcctctctttatattgatttcctctcttatattgactgaatgggaggcaggggagtggtaagggcaggggaccagttttgacacctcttggaaagttgtgctgtagtagctggcatcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctgctatacagggtctgccaggaactgctggagaaaatcttgtaattgtgctggtgttacatatttatggcttcagcttcaagataagtcactaatcctttattatgttcttgaatggcttcctcttccactctttgtcatggctcttgaagacccgttacagccccaagaccccgtggtagtagtcctaccttcttgccccttgtcttcacgctctcctttactgacacttaccttgaggttatctaccgggacatctagagcctattgttcgaggaatgcagtcttgcaagcctactctggacccgagcagctgacctcttcttccacgccccccttctcgctatctcttttaccaataaatatggagggctatgtaaagctcagggcccttgtccactagaggcaaggtgccccctgaccccttcttccaaacatatttttttgtctcttatctttattcccacattcatcctcctttgttcagtcccctaaggtctgtgcaggttacaattaagcaagttggcctcttgtttaaatccttcccttgactctctctccccttaggcctcccctgtctcactcttttcttcattgctggacttttagaaagcatatctctacccactgctttcacttcctgatcacgtatcactgtcaaccaatgtaatctactgtcccctccatcatcacacaatggatctacttcagttaagttaccaacatcttcctaaaagatgaatccagcaggcatttgtgtctttatttttgacaactctgctctgttgtggattttgaccatctccttctggaaacatcgtctactatgattcctaccacaccactgctggttaaacttttaactctctgttcactatgttttattttccagcctctctttctctgtccaactttttaaaatcagtgatcacgaggagtttgctcttggtcatctagtcttttcactcagttgatgttttgtgtatgataccatgactctcatgataacccatgtggtcacctgttcataattcctgtcctgacatttctcttgagctttaggcagcctatctggacagctctacttggacacccccacacacctcaaattagttttcaaaaaatatattttttaagtccatccaaacattttcatcactccaatttactagaaactataaaaccagccttcatctttgggcatagcactctggagctgattacctccccttcaatcctgactcctctcttgattagctgggtgagcctgggcaagtaatccactttccatgtgtcttagtttctggaaattaagcatatcttccttaaaggatggacatgaagataaaattagataataaaggcaaagctcttggcaaagggctcaatatgtagtaacttccaccaaatgctgtgttttgttattgttgccattattctattcatcattcattcaacgcttctgagtatcctcagtgattcacttggcattgtgctagggactcactccacacccttatctctctacattctgtagatttttacctcttaagtgctctaagatctgtcaatctctctctgcaccaccatcactcctcagggtggggccacattacttattatctacactgccacctctcccacctattttctctcctgctccaggccatcttcctcactgtggccagagggatcttcctaaaacaggaatggtcaccccctactgaaaatccttcagtggcccttcagtataaacttgtactgcttccatgttgtcaagcccttgtgtctgctggcctagctctagccatctggagctacttggaagtttgcacactatgccctgttgggttatccctttggaccaggtccatgttcttccttctgctgaaataagcttctcctccacctccttctattgtcctcctggtgttttgctttctcctcctttaagattctgttgaagcattacctgctgctgtaaaaattttaggaatttttacccgtttccttcctcttcccccacctgctgaggtgggggatgggttgctttgttctccgtgttcttacagcgttttatacatatcttgcctctcatgatcaggggctctatctttcttacccctaggttttttaatgtctaaggcctggaaaaggaggtttacagttagcagtattttattaaatacttaactcattaaagtcataaatgtaaaactgattctacattaaactttaaaaaataacttacaaattttataaattcatttgtaaatctgatatttatgttaaaatgaaaggcactccagcctgggcgacagagactccatctcaaaaaaaaaaaaaaaagaaaggcacttatctttgaacagtgtttaatttataaatttaaccaattaaatccctcaattaatactatttataaattctgttaatttcccttaaacattttaaagtgtagtcatacgtgtaatcatatgttcaattagtcatccagttctcacagagatccaaatctgatcaaagaaacaaatgtcattcactaaataaatgtttactgagtgcctagcatgtgtggtaactgctccaggcttggagactcagtgattaatagtcaatgaaatgaccactgaatggtaaataccgagaattgtgccaactgtaaacctgagtaaatgattattagtgttttaactagtgtcactgcaacctgagtaaagtatataaaatcctatcagtacacaggaccttagaacaaacaaatacacaacaattacacagtagggcctggccacagaatgaggagatctgaataaaatcctggaagatgacactagaacccaagagcctcgcaactccctgatatttaaaagctgcattatttcaggaaaaggtaccagtctgctgaaaaatggacacatgacactggagaagatcatctgaaagggagagggtcgggaagtcctgttgactgctgatgtggcagctatttgatgataatgaggggctgaacaaatgccagctcagatggaatcattctggaaggtgcactcacattctgagtccaggccctaatctccagtcagtaacatggagcttgactttattgtggttcccagtattttatggggtaaccacagctgacctgaggtggttattgtgctgtccttgattgggcgaactacttggaaatttgagataaggaaataaatccctggtgtcaatgcttctgtattggatataatgatagtaataagatatattgatagtaataagctttgcaggcatttttaggtgtgtgttttgttgctgcctccttttgagcccctcttcccggaccacacttttgctggagttcacagagcaggctggagttcatcaatgaagccctggaccaatgtggccttcaggccccacatgctgagccctatcaagtgccatatctctctccactattggtcttgggtgagatgctgcattgggggcctagaacctggcttctcgagtggctgtccaagggctggagggtgaaacccggaagtgttgggtctttggctcctatggtgaacctcaaccaatgggagaggataggatggcactgggcagatcaatttcccttcctttctcccttccagggactactctgaggtgcagtttcttcttgcagctctttgtgagaaagtccggtgtgctgatggacatggttgcctagtggcctggagtgttttgaaggtggctggtgcagttacaccctttatcccacaatccttggactctttcttggccttgctctctttcctcactcttacctgggctagtaactcgcacaataaattgtcactttaatccttgtctcgggctctgctttctagaagacaggggctacgaaggccctttgaaaagagttataatcatggattttggaatatttcttgtcctctgtgtatccctgaaacttagtactttttggaattggcttatgcttttaatgacctttagaccagaaaatattatatttttaaattgttttcacctgacgtttttagtgttccaaagttgtatgcttatcagaaataagcaagaactctgcaattctttgaaggccaacagcttgttacactgtttatagcataattaacaactttataacatttatgaaagtaaatggattaaatttgtaattattgtctggaaaaactgtatttttacattttatgaaacttaagcgactcaagttatgccatatttcatacataagctgaactttaattttagattcatgattagtacatcataaaagtactttctgtgctaacatttttctcttcctgacttatatatttaaaaaaaattccctttgctaatcatgatcctgtttaatattcttgggaaggttagaggtggaattcagagtgagattattggcatcgcaagaggaacagacactgaaaggtcaatttattcaatttcgtgtttgggtgcaagatctcagttactcgtcctacacatgagaaaacccttcttgcctttaagatttactggcttctggctgggtgcagtggctcacgcctgtaatcccagcactttgggaggcctaggcaggcagatcacctgaggtcaggagttcatgactagcctggccaacatggtgaaaccctgtttctactaaaaatacaaaaattagccaggtgtagaggcccacacctgtaatcccagctacttggaggctgtggcaggagaattgcttgaacccgggaagctgaggttgcagtgagctgacatcatgccaccgcactccagcctgggcgacagagtgagattccgtctcaaaaaaaagaaaagaaaaaaaagacttactggcttctttttagacacagtttgcaggaaaggaagggaacctaataacccattagaaaaataggtgttttataaataatgttaattgcagctatttcacattcagacaggtataaccaagactaagcttcactctaggaataatataaagttttaatcagaagaatagtttcaagttcttagaagaagtggtgtgtctttagatcaagtgacaactatgtgtctaaattatagcctttacccaagggtctacagactttttaggaatgaccttcacctgggtgggatgcattcccctcatcagtgtgtggaaatggacagcggatcagcatcccagagcctaagggtttgccgagttggtgatcaccatcagcagcaccttccttgggtgccccagggcaagtgagtaaccactgccatgtttggtgtaatggtgagtggaggtatcccacccacagtaggagacaggagaggccgaggcctccacacccacgtgtgcatacttcctggattcagcatgtgtctcccaaattacccaggaataggatgtaatgccttgtatctgtgacttttggaggtaccttatatatgcctgtgtgaatgaataaatggatggatatgaataaatgaatgggcctggggtttttgttttgtattgaggcaaagtctcagtctatcacctgggttggagtgcagtgtgccatcatggctcactgtagcctcgaccttctggggctcaagggatcctcctccctcagcctcctgagtagctaggagtacaggcatgctccaccttgcctggctaattaaaaaatacatatattttgttgagggggtttcactatgttgcccaggctgggggctcaaggttttctcatgggtttatttgctaattgtgtttctcctgttatgacttgttcacacccttggcctagccatcctttggagtattagtttttttcttatgaatttggatgagctcccaatatatataccagaggcttatgtgaccagaggcttgaaagaacctaacttctatttcctttaggagcaatggttcagtattcattaattgagtgtttgtagtggcttttaatagaacataattacttttaataatgaaagtccactgtatttatttcacacctcttgatttttctgttcattattttggattgtttttaaataaatcatgtatttcatacatcacttatgttcattgatgaaacattataaaatacaaaaaaagaaaaaaacattataaaatacaaaaaaccaccagcaaaactgttatccacatctcattaccctatattgttactcttaatattggatatatacccaatattattacatttacatatgttcataaaaatgcaaaaatgaaatgtactggcttctaacctgcttttctcacttaatatattgtgatgatttttctatgagaatatggatccacatcataatttttagaagttgtataatatggaaaaactacaatttatttaaagttttctaattgttagatatttaagttgttaccagttttcactaataacaataagtgaaatttattgagtgtttgctgtctcagattatgagtttaagatgtttatatgcattatttcacctaagcctcaacaaccttacggggtaggtattttgttctcccccagttttacagatgagggaactgaggcacaaaataatatacctaaagtgaaaaataagtattgcagctgggattccagtcctggaaacttgatttcacatttgtgttcccaactagaacaatgtataattagtgattctgtgctactgtctttggcaatttcctagggaaaaaaagtaatcctgaaataaagttgctgagtcagcactggatattttaaggacttttgttatgcatcgccaagttatgttccagataatttctccctcaaatagtgtaagaaaaggcgcatttccccatgtctttattaacactaggctgaatatagtattttaaaatcactattttaattgtcatttctttaattgtgagatgaaatgttacattcttatccaccttttaattcttttatgaatcactgtttatttccattgtggtgtttgtcttttactggtttctaagaactctttatacattttacatatgattgtcgaattgctgcaaataattttcctgttagtcatttgaaatttaaataggtttttctttttacgtttttattgtggaatctgacataccttggaacagtgcatagaatataaatgtacagcttatcaaatgattatgaagttaacaactgtacaaccaccagttgaagcaatggaatcttgccagtttcccagaagttccctgtgtgttccttcctgatacaatctatgcccaactttctagaagaagccacaattgtggtagccagcttcacagatggcccccagtgattctctccttctggtcttcatacccacccaggattgttccaaggtgggccagtgcgaccaatagaatatacagaaacagtgcgatgttgtattccagattgggttataaaagactgtggctcccatcttgggcttgctcactctctcatggatgaatcactctgggggaagccagttgccatgtcttgacgacactcaggcagccctgtggagaggccccggtatccaggaactgaggccctccttccaaaagcccttagagaactgaggcctgccaacaaccatgtgggtgagctgggaggcagatcctctgcctttcagatgactgcagccctggcccacagcttaactgcaggctcatgagaaatcctgggccagaatcacccacctaagctgctcctggattcctgactctcagaaactgcgtgagataacagccatgtgagctgttttaagctgctgagtttgggggtaattttttagcagagtaatagacaactaacataactattctgacttttataataataatttccttctttatcattacaattttaccaccaatatgtatgcatctctaaacaagatagtttaggtttgcatatttttacctattttatacatgtattttaaaattgggtcttatctcgatattaggcatatccctatagttgcatatagccagcgctcattttatttgcaatctagagattcattgtatgaatacaccacttacatacgtatctgttctcctgttcgtggtcatcggtgttgtcctgggtttgagactattatgaaaactgctgcagtgaatattatgggcatgtttcctggtgcacattccacaggcttctctaagttgaccttgtagtgcactcgctggctaaaggacatcggcatcttcactttttctttaacattactagataatggccaaacctcatcaaataatgccagattatactccaatctgcaggacgtgaaagttcccattattttacatccttgccaatccgtggtattattggtctttctgatttttgcccatctggtgagtatgtaagtgatatctcattgggattttaattttgcattccctgggagtcaagaggttgtgcactctttcatttattgattgactacttgaatttccttttttttttttttttttttgagagatggagtctcactctctcatccaggctggggtgcagtgatgcgatctcggctcactgcaacctctacctcctaagttcaagcgattctccgcctcagcttcccaagtagctgagattacaggtgtgtgccaccacactcagctaatttttgtattttttagtggagacatggtttcactaaatgttggcgaggctggtcacgaactcctgacctcaggtgatctgcctgccttggcctcctgaagtgctgggattacaggcatgagccactgcgtccggcctgaatttcctttttagtgacatgcttgttcaagtattttatccatttttaagaaattagttgtctttatttatttgtagcagttctttacatattctggacactagccctttgttgttatatgctatacaaatatcttctcttactctgtagtttatcttttcactctctaaagcctaatgatgtcttttgataaaagaaattattttactgtaatagggtttattaatcttttcccatatttgttttttaacatgtaggtttttttcgtagttgattttattagtctttgccattatagttcctgacttttgaaatcctgtttagaaaggcatccctactctgagattacacaaatattcacctacatgtggtggttttatttttatgttttcatttaaaaatatttaaaccattcatctgaaatttttttaaagctttggttataacattttttttccctgaatgtgatgaatacggttagcaaatttacagaataatctgacctcttcctactgtaaatgctacccgtattatgaagtgggatcctatatattggctgtatttctgagctttctcttttgttaattgctcattctgttgattctggcactttctgacacctacttgtagttgttgtgctctgcgggacacatctgatagggcctgctcctgcacgttactcttgtttttcggcattgtcctgacattttttacatttttgttttctagatgagctttaggatccctttaatattaacataattatttttggctgtgttgtagatttgtctgtgacttgttagaaattagtgttcccacttaggaatgtggcatgtcttgccatttacttttgaatctttttatgtccctcagaaaaattttgtaggtttcatttcaatagaggtctggcaaattcttattctaagtttttaaaattttttgtttctggtgtgaattggcccttttctcctatgcgttttctgatgcataggttttcaaacctccactccttcagcgataaaggctcccaaggagtggctgaaggctggggagcatcgcagctctgccccatctgtttaccgtaacaggttttgtttatagaaatcattctcttttgctaaaaaaaaaaaaaatttcctgattggttgttactgaggtttgaaaccctgtttttgtgtacgcttttttttttgagacggagtcttgctctgtcacccaggctggagtgcagtggcacgatctccgctcactgcaagctctgcctcccgggttcatgccattctcctgcctcagcctcccaagtagctgggactacaggcgcccaccaccatgcctggctaatttttttgtatttttttagtagagacagggtttcaccgtgttaaccaggatggtctcgatctcctgaccttgtgatccgcccacctcgacctcccaaagtgttgggattacaggcgtgagccaccgtgcccggcctgtgtacacttctttttaatgaatgatctttactgatatcttttgttggttttaattacttttttagtgattcatcttggatcttccaggtattcattcctttattattattattattttttttttgagagagagtctcgctctgtcgcccaggctagagtgaagtggcatgatctcagctcactgcaaccctgcctcctgggttcaagtgattctcctgcctctgcctcccgagtagctgggattacaggtgcatgtcaccacgcctggctaatttttgtagttttagtagagatggggtttcaccatgttggccaggctggtcttgaactcctgacctcaggtgatctgcctgccctggcttccaaaagtgctgggattacaggagtgagccaccgcgcctggcctcattcatttatttattgaaaaaatatttattcagtgcccacccactgtgtaccagacacatttctaggtgcttggaatatatctatgagcaaaatccatgtatatcatatggtaagctcaaaatgagtatattatacggtaactactttggagaaaaagaaaatggatcaagggttctagaggtgggatatgggatccaggcagaattttattttattttactttattttatttattgattgattgagacggagtcttgctctgtcaccaggctggagtgcagtggtgcgatcttggctcactgcaacctccacctcccgggttcaagggattctcctgcctcagcctccggagtagctgggactacaggtgcgcaccaccacgcccagctaatttttgtatttttagtagagacggggtttcaccatgttggctaggatggtctcgatctcctgacctcgtgatctgcttgcctcagcctcccaaagtgctgggattacaggcttgagccaccgtgcccagcccaggcacaattttaaataccgtggtcaccataggtctcattgagagggggacatttaaacgaagacttggaggtaaggacgccggctatgtagatatctgctggaaaagcatgcttggcagaggggaaagcctgtgcaaaggccttagaaacacgctggaggtgttcgaggatcatggaggggtgtggctggagtgcagtgagtgagggagtcaaggttggttagggagggatagagtaggggacagatgtttgtatggggccttagtgtaaagactgacactgagtgaagagaggagccattgcagagttctggaatattgtagggacaagatgggcttacttttttttttcttttgagatggagtctcgctctgttgccaggctggagtgcagtggcacgatctcagctcactgcaacctctgccttctgggttcaagcgattctcgtgcctcagcctcccaagtagctgggattacaggcaggtgccaccacacccacttaatatttgtatttttagtagagatggggtttcaccatctggttggccaccatcatgttggccaggatggtcttgatctcctgacctcgtgatccgcttgcttcagcctcccaaagggctcggattacaggcgtgagccactgctgggcttacatttttaaaagatcattctggttgctcctttgagaatagattttagaggggccggggtagaagcagggagactgattagaggcgattgtaacgctcctcacctaggatcttactgtgcattgagcaattggtaaggcttatggaatgaatgtttttacctacatcgggcattttagcgtgcattaagaaactacacatttaaaaaatacatatttttcttgagaaagtgatgggacagaaaagtgagagcaggggaattgcctttggaacaggccattttggtcaagccttgtcctggataaagaagatggggaatgaaggctgacctgccgtggaggggaggaatgggcaggcatgccctgcctcatctcacggagtgagggcagaatctggggagcgcgttcttggatgtcccaccaactttggagaggaccggaggctggggatagacaaggactactatgatgaaggaagctcgtaagttcgtgtttgcttctaaatggttgctgtggctttctggctttaaactggtttatattttctgcaacctcacttcttcctaactatttagtagaccagaacttctcggtaatttattgctcaatagtgggagaaaggaagaacttcgttttcaggttaagacttcatatgtcaaatccagttttattggtgtgataaatgctggtttctgttaaatttaccaggttggtcagtactggttcctgatacaagaactgtatttacccttttaagaagatgatttaaacttctggagaaaggaagagggcaaagatctttaaagagtatgctatttttatgacgcctccctaattattcagaaatatgaataattcaggaatttaactgtagaataagtataaattacccggttactgccttgaaagagtttacaatcaccttgaagagaatcctgccctcacccccaccagtttcacaaagcctattttaaattatacccttggaaaaattaaaccaaaacactgcgcaaatatgtttggtgtggagttcatttctttgatttagtcctttcactttgggcccacacacttttgccatcctttagggagcatgcccagtgctagattcgaagcgaatatattaatgtatgtgttcacccatcaatgccttgtgctgagggaaaaacagaagagagtgtcatggaaggcttaaggattcttttttttttttgctgatacaaagtactttttgttattcaatgcttgtgccatcatcagacaacttcatccagaatgcacagcaactctgtaatatagctctgcctggtgcaaaatacctcattttgtatagaaatgcaggattgcttcatgtagatacaatagaaagaatctttgctttattcatgtatgaataaaacgtctttgttcatggaagagaaaagtgcctcttattgtttggaagctgtgtgaattttaaattaagctgatggcccactatattacatatttcgggggaaaaattagctttgcttatataagtttggaatctaatgtctaacctagtggcctaaataatttttgctttgcagtttgtttattatgtaaagacattgtgtttgccacagacattgcctgtcaatgaattgctttagcaaaattctatagtcctaattttaaaaagttgttatttattcccttgtcccacataagatttgaagcagcttgcaaaaaattaaaaatacaatgtaaataacagtcataaatcatgatcagagaaaatataaatattttatggaaaagtcaaagcttgtagaggcatgtgtgagtgtatttatgtgtcaatatacatgtaaaagggtccatgaagcagctatgtggatcctcagatttgatgttgagcttcctggcagccaaagtggaaaaaggaaggcaatcagttaatcctttctctgggtttgcaaaggactgcttagagcatatccaccgccaagcaggggtatggcattcgggctttcccaaaagaaagctggccactcagatgttctcactcataggtgggaattgaacaatgagaacacttggacacagggtggggaacatcacacaccagggtctgttgtggggtggggagaggggggcgggatagcattaggagatatacctaatgtaaatgacaagttaatggttgcagcacaccaacatggcacatgtatacatatgtaacaaagctgcacgttgtgcacatgtaccctagaacttaaagtataataataataaaaaaaagaaagttggccaatcggaagaacggattaaataaaggaatgctgtaggtcctgggacccccatgatggtgccttaggcttttccctttgcagaaagtaccacctctggcaagtgacctgcaggactacaggcagaagtagggctggcagagtgcctggtgtgcagtcacagaaccctccagctccagatgtaaacttttggctttcttcaaagtgttcgctggttcttaacaaaatgagaaaaaataagaacaaataaggaaaaaaagtaaatttccttcaaatctgaatttacgtgacgtcagatattatgttcttcctataattttagtattaaaagttcctttttaaaatgaaaacagcagcaatagttcaaaaggttgtgtcctttcctggggaaatgaaaaaagttgaaaacactttgtatacggtaataataataatcactattactactactacgggtatttactgcttatgaaatctaaaagtctagaaactcctatttctcttgggctctacagcatctcagtcagctgctttgtctccaggatcacatttccaattttctctcttttctctctcccagtgtaccgcgcacctgctggttccctcacccagtacatcttggctcccaggaagccacacccttgacatttaccatgcttcctgggcatttcctgctaccatccccaccctggacagggctaggatggtatcaggacttagtgctgcacaagctttcaggataccgggtaagaggggagtttgacacttggaacaatactggacctaaaaggagccaggccttggatggacagtcactctccatgagtttttgcaccatgtcagcactataaactcactgcagtgggagtttcgcattgacaagggtcttcagacctagctcacctcagaaggtaaggggggccttgacaggtcctctcaagggggataaatgccacctgctatttaaggagacttgaccccatccctgcttctatccattaatgggtgactttttaattcttctggaactcttattgccaaggtcttggtgggactgagggtgagatcgcttttctgtaacacagatgcattgccattttgctccttgatagtgtaagatgtttaagtcaattaagacaaaaatgtgcttaatactcttttcatttgccttaacaactccacgtttatttaatatcagtttaattcttggctgctgcaaggtctgggtagttttcatttcgaaactactcctagggtgagaagtctcttaagtgcctgtggtattcccaaagaatttgcttttgtgcggcagtcacagcctggaagcgcgctgctttctttgctcctggtgtcagaaaagctactcctggttctcagattgggctttcctgcacattagaattggaaaggtcctctttgtgtctgcccctgtaagggagccaaacaaaaggcgccagagtggtggtagggcagcatcatcgctccctaacctccaccctcctccttctctcttccttcctccccgtccctgcctccctggcctccctactcctccatcccctccaagactctcaatgtagtcagcgctctgttttccccacctttgcctggctgccacctccctccctccctctccctatcagcttcctccggatgaggtgctattctgcatggaccccttagagtactcattaactagatgaataagctgccagcaatattgttcctgcttcccacattttaaaaaggttatctctttctttttccttctaaactttagagccatttgaaaataatcttttggaaatatatttacataggtctcatgacaaatccacatactccttttcagacaggtttcaacgactgcataatgagatggtctgggtcagctttgcacaaaagttgtacttttcctgctgtgaatctgtatttttccgctgtgtgtatttgcaatgactttcccgccctaccttccactagtgatgcattaatcacagcatggagctgagaggcgtgggattggaagggtctttgagaagttttttaatcgagctagaacgaggtcaaggttttgagcatttaacttgtgggatgttaattacttggctatgaaaaggaaatttgttttctgaaagttcaactgtagctacagaataaaggccatggaaagataaggcatggtgtcaagaggtttcatgatcttattccacctccttttcaggccccaactccactcaaaccctccactgttgagccacactggatgtgtcaccctctgtccctagacgtgctggacatctgcatcctgtggtgcctcggctcaggcttctctttcatctgggaaaacccttgaccctctcctagacttcccaaatgctgcttcaaggcatcatccctgccctccttcctttagaaagtcttttctaccactgagaacacttccctcatgctccaccgcagactgtacttcatgctgctttgctctttgtggttgatgcatctgtctctcccactaaatcatgaccctccattcatttctacttcccactctacccagggcatggtaggtgctcaataaatctttgctgaatggaattttttcatctaacccaagagcaacctgagcagaaaatcataaatgaataaggatcgtaaatggatgatcatcataaatgactaatcatcataaatgaatgcttatgggatatacacaaattgcagaacactgatagctatggcatagctcttatcctagagtgagtttcaattcactttaggttaggacatagaaaagacaaggagaaacaactagtccatgaggattttttccatgctttgttctttccatctgtgctgttcagtagctagtttcactgagcttccctgtagtggatgggtagagattgtgtattataagtacttgctcatcagtggctcaagggcaaaaatctcagtgcctagagtttggcataatattatgtgaaaaataattttttgcaatataatgagatgtgacactccccactttccagaacaaggacttgtctcctttggatttccagacctaaagaagaacatctcccttgaaaaacttttcccactggcaattcagccctctgttttccaaacccacttagaagctaagttgcactggaaatacacaatgaaatgtttatgggaaaaaggggcatcatatccacaatttgttctcaaaatgatttagtggagggagagagagagagagggtggaaagggtgggttggagggagcaaaagagagacagagaaaattgataaaataaatgagataaaattgagggaatctggcgaagtctattggagcattctttgtagcattggggaattctttgtcatatgcttgcaacttctctgtaaaccagacattatttcaaaataagtttttttgaaaagcaaaagcaaattctttgaattcttacccagtttaaaaggatgatatgattgcaaaaaagttgtgtttctctatctataggcataaatggtagtgcttggcagtttaggatccattcacacagaaactgcatttgaggcaggtgtttgtgagcaccttttgaccccttgacatttaagcaaaggagaagtgggttcctcttattcgcagctgtcataggtcagacttctgcttgttgggcgtgtcaggctgggaaattcccctcaccgccaagatgtccatgtcctaatccctaggacctgtgagtgataacttatatgagaaggcaatgcgaggatggaagcaagagattggagtgatgtgaaggagagatcagggtccaaggaatgcacatgacctctagaagctagaaaaggcaaggacacggatcctctctcctagagcctccagaaggaaccaaccctgccagccccttgattttagccctggaagactgattttagacttctgacctctagagctgtgagaaaataagtctgtattgttttgctactaagtttttggtaattttttatagcagccagaggaagcaaatctactgggtgagtggattctatgcccgagttcataagtgagagtgaggccaaggcatgagttctggattattgtcattagcatttcaaagaattgtcctctggctcaaatcagcggtgttcacactttgcttaattgcctgtgtcttattttgttctccagctttgatcacatgtatgacaaatggaatcggaatgaattgcagaactagcaggtcgagtgcttgacatcacctcacagagatgtcatggatgctttgggaagtgctttgcttgacagtgcctggatttatgtagcaagatattttgtcctggggtaaagggagcccatgcaggtggggggggaggggaagggaatgggagctgatgcctaggcaggtttctcaaacctgtgtgaattaaggacccctctccataagggacttttttggtgtattgacttaaatttagttttattatattgctacttaaatctgtataaacataaaactaagtgttaatttatgcttatagctttaagacaactataaactccaaacatttcaaattaaatgcaaataaaattacaaacctaataaaattcaaattaacatcactgagttaatgtcatggataacgttttgctgattttaaattgatgttctcaatgtgttttcacacacactcgtgaagttatggaacattatctttgtttctgctggacttgtttaattcactgtaaaaatatcgttatgttgaaagaaacatatacatcacagtaataaattgatttatctagaacagttttcagactctaatgcaaatattcagttggtttcattcctggaaaaataaaaaacagaccaagataaatcatagtatttagtgatgtacacttaggggattaaagtcagtgtagtaataggctatgagaggaggggggagggatacatggggggcttctggattactggcaaggctcaatttcatgatgagcatgcctttcttgagtctctctttttctgtgaacataaaacataagtgtactgactgttggatttttataaagtgaacactaatgttaccccatcaaggacaagaactaggacattgctagcatcccagaagctcccatgtacccttttatagttacatactcctctttcccagcaaaataacgactatagtatgttttgtggcaatcacttattgcttttatctatagttttacaacctaagtaggtgtattaggccattcttgcattgctataaagaaatacctgagactgggtaatttataagaaaagagatttaattggctcatggttctgcaggctgtacaggaagcatggtgctggcatttgcttgggttctagggaggcttcgggaagataacaatcacagtggaaggcgaaggagcagcaggcacgtcacatggcaaagcagaacaagggtgggggaaggtgccatacacttttaaatgaccagatctcatgaaaactcactatgaccaagacagcaccaagtcatgaggggtgtgcctcatgatcaaacacctcccaccaggccccatttgcagcattggggattacaattgaacatgagatttgggtggggacaaatatccaaactgtatcaggaggcattcctaaatactgtgaattgaattttgcctatttttgaacttctaaaattagggccatatcgtatcttttgtgtttgactctttcagtcaacatttttttttttaaagatacatccatgttgttctgtatgactgtagttcatttttatggcagtatagaataccattgtataactataccatacttttttgagctattttcctgttggtagacttctggggtcttttcagtttttggctattacaaatattgctgctatgaacatacttatacatgtctcctagaagacttgtatctaaaaatagaattgatgtgtcatctggtgttcactgctagatgatgacacattgttttccatgtgactttctttcttttctttttcttttcttttctttttttttttttttttgagatggagtctggctctgtcgcccagtctggagtgcagtggcataatctctgctcactgcaaactccatctcccaggttcaagcagttcttctgtctcagccacccgagtagctgggattacaggcctccactaccatgcctggctaatttttgtattttttagtagagatgggatttcaccatgttggccaggctggtcttgaactcctgacctcaggtaatccacctgcctcaccctcccaaagtgctggaattacaggcgtgagccaccatgcctggccatgagtttcattttaatttgtgtttccctcattttgattgaggttgagaaccttttcgtatatttattggtcatttggatttcccttgttgtgaaaggtctgcccaactattttgtccatttttctctttttcagtcttcttattgatttgtagaatatatattcattctggatataagcccttgtcggttttatgtcaaaattatttattttgcagatctctctctcttcttttaaaaataattttaacctttaatttagattcagggggtacatgtgcaggttttttatatgtgtatattgcatgacgctgaggtttggggtacagttaatcatgtcacccaggtactgagcatattactcaaaagtcagtttttcacccctcacctccagttctccctcccccttctagtagtccccattgtctattgttgccatctttgtgtccacgagtacccagtgtttagctcccacttataagtgagaacatgcagtatttggttttctgttcctgtgttaacttgcttaagataatggcctctagctgcatctgtgttgctgcaaaggacattatttcattctttttatggctgcatagtattccatggtgtgcaagtaccacattttctttatccagtccactgtcgatgtgaacctatctttgctattgtgaatagtgctacgaatgaacatacatgtgcatgtgtccttttggtagaatgatttattttcctttgggtatatgcccagtaatgggattgctgggttgaatggtagtttcgttttaagttctttgagaaatctccaaactgctttccacagcagtcgaactaatttgcattcccactaacagtgcataagtgttctcttttctccacagcctcaccattatctgttgttttttgactttttaataatagtctttctgactggtgtgagatggtatctcattgtggttttgatttgcatttctctgatgattagagatgtggagcattttttttgcatgtttttggttgcttgtatgtcttcttttgaaaagtgtttattcatttattttgctcatttttcaatggggttatttgttttttgcttgtgcaattgtttaagttccttgtaaattctggatattagacctttgttggatgcatagtttgcaaatattttctcccattctgtggagtgtctgttgactctgttgatagtttcttttgctgtgcagaagctctttagtttaattaggtcccactgctcaagtttttgtttttgttgccactgcttttgaggacttagtcataaattctttcctaaggctgatgtccagaatggtgtttcctgggttttcttctagaattcttatagtttgaggttttatatttaaatctttaatccatcttgagttaatttttgtatatggtggaaggtggtggtccagtttaattcttctgcatgtggctagccagctatccctgtaggtgtgcagctttatttctgggttgtctgttctgttccattggtctacatacctgtttttgtaccagcaccatgatgttttagttactgtagccttatagtactgtttgaagtcgggtaatatgatgcctccagctttgttctttttgctggtgattgctttggctatttgggcactttttagattccatatgaactttagaatagttttctctagatctgtgaaaaatgatgttgctagtttgataaggatggtgttgaatctttagattgctttgggcagtttggacatttgaacgatattgattcttccaatccatgagcatggaatgtttttccatttgtttgtatcatctatgatttctttcagcagcgttttgtacttctcctcgtagacatatttcacttccttggttagatgcattcgtaggtaattttttgtgtggctgttgtaaacaggattgcattcttgatttggctctcagcttgaatgttattggagtatagaaatgctactgatttttgcgcattgattttgtattctgaaactttactgaagttgcttatcagttctaggagccttttggtggagtctctagggttttctaggtatagaatcatgtcatcagtgaagagaaatactttcacttcttttcctatttggattccttttatttctttctcttgtctaattgctctggctaggacttcctcttccactctcttactggtatctgttggtcagtggaagttcttaattttagtgtagtcaagtttatccttcttttccgtatatggtaagtatctatacgtgtaagtgtttatacgtagctgttttagacatctttttcaatcccagattatgaagctactctttatttcatcttctaaagctttatagttttgtttttcacatttagtattgtaagtcaagaactgtggagtgtctgaaattttgccttacttgcaagctaacaagttagcctgccttagtgtcacgaatgttgccagaagacacaagactccgggtcagagggtcggagacaaatgactttgccagagtatcggcatcttcttgtgccagttcccagagcccaaattcctacagagcaaatgtgtagagggtcaggtgacttgtacacctggagtgaactgtgttagaggtgaggagccctgaggctagggaacccaaatcttttataatgggctgtaagcttgcctgacctttgcccagagggagaaattgtctttatatactggacagtaaacaagtctgtcattttccttggggagagacactatatcttctaagactgtttgccatacaaatatcctttgaagagatagcaaagaacaaaaaaaagcagagtgtctgccttcaagacttgcagaaacatgagggatttagggaaaactgtctcccctaaggtgtaatccacctgttagtaatttgcgtgtggtgagaggtaatttccgtcattttctatgctgaaactcaattatcccagcatcatgccttggaaaagtgggagaaagctgtcttccaagagataggtgctggtgaattagactgaggttgctgcagtggaggtgaggagtgggtacagactgagctacatgcttcagagatgacagagctccatgggctgttgggttgttgaggaaggggctgaaggaaggacaagtgtcaggagtaagagtcttcttcgttgagtcttaaaatgtattgtgtccctagagaggaaaaacaatcatttaaaataggcctttactgtattgaatactggaaatttgctaagatggtagattttagatgctcttacctctcccacccacccccacaacacagataactatgtgagatgacagatatgttaattggcttgagtgtagtaatcatttcactatctatatgtatattaaaacattatgttgtgtatcttaaacatatgcaataaaaattaagcaaaaaataaaaaggcccgtatttctcttaacctgttaaatactcggtataaatttgaatttagaatctgaagtggatcatgcacctggaattcctgcgtgtccagctggcctctttctgaggtgtgtttcctcttactgatatttattcttccctttccagtctgaaaagcagtctccatggcagaataattggtaaccaaatgtagatctatctgcaatggaaagtgacattttgtgagcaaaacctcaactttttaacaaaagaaaacaaaccgtagagcaaaggagattttctttcattagccagggtccagttaggatacaggaaccgtgctaagtatttcacatggaagggatttcatacagggatctggctatacagggtctgaaagtttgaaaaaattaaaaatggacactacctttaggtgctgggtgacaaaagggaagaggtggcaatataaaatctaggtgctcagagaaggagctaccttggatggtgctgaggatggggaggggagagctgggaatggaatggcccaggagataccacagcgctcctgctttacccgctgctggaaggatgaccgtcaaggctaaaagcaggaacacagtcctttcttcccagctccttctttccactgtcacaacataaccagaagccagcagcaaggaagcctgagaaatgtagattgcagagtagaatcactgagtggaggttggggctgagagacaataggcaaataaccagcacagagtctaagcagcaaaccgttcagattagctcctcctacaacaatgtgaaaattggaatgctcattttgttgctacttctaggaactgtggcccgtgggtcagttgggaattaatggcaaataaaggagattctggggcagtgtttgcttatgtgttgtgtctgattaatttccaaaatcaagctgaattaattttggatttatatgcattcatttttgaggtcaaggctagaggtcataatatctgaggtctcattctcgccacttttcctattgctggaatagtggtgctatgtcggggagaggacacagagaggaacaggcactgagaaagggagggaaatagtgggttcagaattgggacatccaggaggcagctggaaacgtgagtctggaactcttgggtgagatttggggctaaagataacaatttgggtgcttgatggtaagcacatcctttgagagtatatgcagtttcccaggagagaatgtgggagaagagttgagggaagggttgaaaaccttggaggacaccaacattttcaaagttagaggagccagcagaggcgagctcatcctaatggagatcacttcgttcaagcagattatttgcttgaaactttcatctttggtattatttgcactgtagtggaatgaacaaccataatgtgagtttaaaacccagataccaaaatattgtttgtttatagtctccctcaaactccatcttccgtaagtgctggtgtggggattatgtacctcttcacttctcttctctgcactgttgataaaggaagaggcaggttttgctgaccacattttggcaaatctgttggctctttcttgggcattcccatgctcatggtcacaatactgttactacgttaatttaactctagaattgagtttaagccactaatcacaatttctttttcttgctttgtcattatagctgctttttgaaaagcaaaattactaaatttcttaagtcaataatttcaggttgataaagaagaggcaaaatatatgcaggctttaaaacatgctctgagaccacagaagggtctttttctgatccaaatatcctattaaaactgtgtgactataggaaaaagtctgtgtaggctagagcaagttcagttgaaaacctatttttaaaaacacttaaataattacctttcatcctaaatcatagacatggtcagcattgtaagaaaagctgatacacccaaatctgaatatatatgacaaatagatcattaacaccctttcattttaccaaagtattctttgatagtgcctttaaataagccagtttctaaagtaaatttaaaatgtcttcaattataaaaaatagatttacatgtgatgtttcaaggacatatcttgtgaaggaagtacagttgtaaagtgttgagcaaagtcatgaaagttttcacaagaaggaaaagaataacatttatttctaccttttcttttttcttatcagcatctcaaaatagaccaacagtatattccattgttactatttatttgctgcaatacaaatgacatctcatttgattttagccctttaaccttgagctaaaatgaccctgtggaaacaaatgagcactgtagagacacctgcccctcagaagagtttggaagggcagagttctgtgggagagtttgcctaggaagtggtgcggggtgggctgcccgggaagggtgtgtggagtagagaccaagaaggggctgaacgccatctcccaggaagcttcccaagactgacttttcttatatgtggcctccaggcagaggtggggaaatccccaagccttcccagagggcagtgaggctttctcaccttaacttttgagttaggaattagttcacattagcagtttttggctccctgaggctgagattggggagcttttctgaaatcatggaaatttctggcccttatctctagatgaagatcccaccttaattttatgtatccaacatagcctaaactattgttctttttttctgtctctgtcttcctttccccctgcctccctccttctctctcttctttctttctttccttcttctcatttcccagtggtctggtctccaaaaacaaatgaatgtgtgaaatcagtgaggattcttctccctggaaacaatgtgttgttggcaaaagcaacaactgcctctgcaaacatcaaaatcctccaaaagagtgaatggggaagatcatatttggtgttcagcaatctaaaaaaaaaaaaaaaaaaaacagacagcaaaaacccagaggaagtgaagaaagttagtaggaactggtaatactatacagatgatttcttctccacctgtttggaagttttgcttaagtctggcttttcttgcagtattaggaagtgaatatggttggtgtaagagaaggtgacagtggatactatacgcagggagctctgtggagccttgcagccctgcaagtttttatttgcaaggtgttggttgaatcagcctttcctcctaaaagtttcagcacatacaagttgctgacttattggctgttttcttcttttaacccaaattctgtattcttagttgtgttgtcatgaaggatgcatcttctcattttcaaagtgaaatcaaatggatccatgcctttcacatgtaactttctgttcaactgcttaaaattatttttattgatccataacatttgtacatgtttatggaatacatgtaatattttgctacatgcatactgtaatggtcaagccagggtatttagggtatctatcgcctttgtatttatcatttccatgtgttgggaacatttcaggtcattctcttctagctattttgaaacatacaatacattgttgttaattatagtcaccctactctgttatcgaacattaaaacttattctatctaactgtatgtttgcactcattagctaacctttcttcatcccctcaccccgcaacacacccttcccagcatctagtaactgtcattctgttctgcctccatgagatcagttgttttagctcccaaatatgagtgagaatatatgatgtttttctttgtgcctgacttattttacttgacataatgacctccatttccaaccatgttgctgcaaataacaggattttattcttttttatggttgaatagtattccattgtgtatatattccacactttctttatccatttatttgttgatgaacacatgattctgtgtctttgccattgttaatggtgttgcagtaaacatgggagtgcatgtatctctttgatatactgatttcttttcctttgaataaataccaaatagtgggattgttggattgtatggtagttctatttttagttttttgagaaatctccatactgttttccataatggctgtattaatttacattcccaccagcagtgtatgagagttctctttttttcatgttattagcgtctgttattttttgtctttttgttgatagccattcgaatttgataagatatctctattgtgtttttgatttgcatttccctgatgattagtgatggtgagcattttttcatatatcttttagccacttgtatatcttcttttgagaaatgtctattcaatatgctattttaaatgagattctttgtgcgtgtgtgtgtgtgtgtgtgtgtgtgtgttttgctgtggagttgagtttctttgtaaattctggatattagtttcttgttagatgaatagtttgtgaatatgttctcccattcaacaggttgcctcttcattctgttgattgtttcctttgatgtgcaaaaactttttactttaatatagttctatttgtttaattctgtttttcttacccatgcttctgagatcttagccataaaatgtttgcctagaacaatgccctggagtgtttcccctgagttttcttctggtagttcatagtttggggtcttatgtttaagtcttaaatctattttgagttgattttgggatatggtgagagatagggatccaatttcattcttctgcatatggataccgagttttccgagcatcatttattgaagagggtgtcctttccccaatgtatgttctgggcatctctgtaaaaaatcagttggctgtacatatgtggatttatttctgggttctctattcgtgttctgttggtctgtgtgactatttatatgctgataccgtgatgctttgattactatagttctgtaatttttttgacatcaggtagtgtgatgcttctagctttgttatttttgctcaggattgcattggctatttgggctcttttttggttccatatgaattttatgactgatgtttctatttctataaaaaatgtcattggtattttaatagggattgcactgaatatgtagattgctttaggtagtatgttcattttaacagtactaattcttcctggctattattaaaaagtcaaaaaaatcacagatgctggtgaggttgaggagaaaaaggaacacttatatactgttggtggaattagttcaatcattgtggaaagcagtgtggtgattcctcagagagctaaaaatagagctgccatttggcccagcaatcccattactggggtatatccagataaacataaattgttctatcataaagacacatgcacacatatgttcaatgcaacactatttgcaatagcaaaggcatggaatcaacctaaatgcccatcagtgctagattgaataaagaaaatgtggtacatacataccacggaatacaatgcagccttaaaaaagagtgagatcatgtcatttgcaggagcataaatggagctggaggccattatcgttaacaaagtaacacaggaacaaaaaaccaaaaactgcatgttcccactcatgagtgggagctaaatgatgagaacacatggactcttagaggggaacagcagacactgggccttccagagggtggagggttgaaggaaggagaggatcaggaaaaataactaatgggtactaggcttaatacttgggtgatgaaataatctgtacaaaaaacccctgtgacaggagtttgtcatataacaaacctgcacatgtacccctgaacttaaaaaaaaccaaaccatattaattcttctaactcatgatcataggatgtctttccatttgcttgtgtcctcttcaatttctttcatcaatgttttgtaattttccttgtagagatctttcacctccttggttaaatgtattcctaggtatttctttggtaactattgtaaatgggattgccttcttgatttctttttcagctatttattataggcgtaaagaaatgctactgatttttgcaggttgattttgtagcctgaaactgtactgaatttatcagatcttagagttttttggtgtagtctttaggtttttctaaatataagattttgtcatctgtaaagagaaacagtttgacttcctcttttccaatttggatgtagctattggatgaaatgttctgtaaatgtctgttaggttcatttggtctaaagtgtagtttaaatccaatgtttctttgttaattttttgcctagataatctgtctaatgttgatagtgggataaagtcttccactattattgtattggagtctaactctccctttagatataataatatttgctttatatatctgggtgcttcggttttggtgcacatacatttagatttattatttcattttctttattgatccccttatcattatataatgatgttctttgtttccttttactgtttttgacttaaagtctgttttatctgacataaatatagccattcctgctcacttttggtttctgtttgtgcagaatacctttttccatccctttacttttagtttatatgtgtctttacaggtgaaatgagtttcttatgggtggcatatagttggctaatgttttttaattcagccagtctatattttttaagtggaatatttactctgtttactttcaaggttattattgatatgcgaggacttattgtcataattttgttaattgtcatttggttttgtggttctttgttcctttctttctctcttagtgtttatcattgccacttgcaggtcttctgtagtggtaacatttgaatctctttttttttcctcatttgggtgtttgctctaccagtgagttttattcttttgtgtgttttcatgatggtagatatcatactctcacttccagatttagggctccgttaagcatttcttacagagctggactagtggtgatgaattatcttgtttttgcttgtctggaaaagactttatttctccttattttatgaaggataactttgctaggtatagtatttttggctgtcagcttttttctctttcagcactttgaacataaacctcaagcttattctctccttgcttgtaatctttctgcttagaaatctgctattagtctgatggggggcagttcccttatgtgactagatgcttttctcttgatgtttttagaaatctctgtctatctttggcttttgacagtatgctacagagaagacctttttaggttatatccatatctatttggggatctctgagattcctgtatctggatgtcttaatctcttgctagacttgggaagttttcagctgttattttgttgaatacgttttctatgcctttgtctttctcttcattttctggatcatccagaatttgaatatttggtcactttatggcatcccatatgtcatgtaggctttgttgattcttattcattcctttttcctttttcttttttgtctgattgggttatttcaaaacatttgtctttaagttctggaattcgtatgcttaatctagtctattgttgaacctcttgaataaattttttatttcatatattgaattcttcagttccaggatttctgttttgttctttttttcatatctgtctctttagtgaatttctcattcacattctgaattgtttttctggtatctttgtattgtttatctgtgtgctgttgtgtcttactgagcttccttaataacattattttgatttttttctgatatttaaaaaatttctatttcattggaatctgttgctagaaaactattgtgttcctttggaggtgtcatatttccttgctctttcatgtttcttgtgtttttatgttgatatctgcacatctgatgtaacagtcacttcttccatttttttggattggctttagagggggaagactttttcctgaagatgtgtttatgttgatggttaggtatagtgccttagctttgattctgggtgcaggcattggtgtagtctcggtatgatttatttgattgtgaacagcatggtgtctgtgattgtctcagtggcctggctgtggttgttagtggatgctgtggtgatgctttgctggggatgcctttgctggccccagcaggtgggccagtcctttgtgcccagtggtggcagtggtgggccaattatgccagccattaggctgctgggcagtgtacatgggcaccagtgttagcagatccaggcaggctgattcttgggcctccaggtggcttgctcagattccagcagtggcagcagtgggctggatgagtgggcaggtcctggggcccctgggcagtgtgtgtggcatgggagatagtagtaccagtggcaggacaacccttaggcttccaggcagttagtgatgttagtgatggttgtgatgggctgggtggcccctcctcaggtccccaggagtacaaagataccagtggtggtggactgggtagagtgatccgcaggcccctgggtgatgtactcaggcactcaagtcaggggtggttgtgccaggctaggtggtcctgtccttaaccttctgatggtatgcacgagtgcaggctgtggtgggacaatctgtggtggtgggtggggagagcttgtccccaaggtgcagataagtgcgcagcatccctgctgctcagtgggtggggcgggggtggggtggctgttagtgggagtgaccctaggcatttgggcagctttcaggctcttgggagtgtacacattagtccttagcagcagcagtaacagcaatgatgacagtgggcagggagcctgtcctcagagtgcatgctagtgcatagtggccacgcaggcaaacagctgtcaggctttggggaacatgcacattggctccccttgtttcagcagcacagcagcagcttccctggtgtgccacaccacccattccctgtggtgtgggactcttgagtgggctagagtgctagggaccctgctgcactgctgggtccagccagcatcatgctactgcagtcctccagtgtagggggttgttagtggtgcttcagggatgtcgagatgcaggggctatggcatcccagggcaggatgccctggttgaggttaggcactcagaatggtgctgttctgcagttgcttaggtatcaggggagtgtgtagagcactgttagttctctttctggagcaaggcctttgcacaatctctaggcagctccctgtgctagtctcagggcccaggaggatagagaggctcttccatggctaagatgacaggagtcaatggtgggaatgtggacttcttgggatctcttaccctttccctgcaccgggaacctctccaggcttctagctgatgccagctgaactggccgccttgctttcccttactttctgtgcctcaggtgtttcctgtcacttctctgctaaattccagtgttttcttttagatgttctatttgaaatgtgattatctatttcctattttggttcttttttggggaggtggtgagtgccagatacctctagtcagtcattttgaacctccccggcccctcctcaggtcaactgtttttttttttaataagaggatttttgccccttaattttctgggattatgtcccatataattcttgtaaggcaatctagacaaaattttcagtcattaattttgtgctttttttcttatgttgaaactactaaaacaacaggttggcttttcttcagttaatcatcatgattcatcttttccattatttgttaatttgccatctagcaattgtatgatgacaaattcttttttaccttttaaactttactgaaggcacctaggccaggagatcacatggttagagacattacatttatttccttccaacacaaagaaagacagcaaatagtaacaaccccccacccacacctatacccaagcaaaacaatattatcatgtttgctatcctacaagatccaatttcccttgacttttattggagaaaagtgtcagtactagaaattcaaacagaatccttaacatgcccacagattatttcagggatccttcagttcattttcttgagcagtagctggtcagagggcctactactttgtgtgcaccattctagtgctgaggataccataatgagtaatattcatgagtaagaccgtaatgaatataagaccctgtccccaggcatctcataggccactgtgggaagcacatcaataaatttcagcgcagaatggttaagtgctgtgtaagcttttaatgtattcaggagatctgcagaaggggcacccaactaggtctgaggagtcctaatgacctttgaaggctgtgtaggagttagctatatggaaaaacttccaggcaatgggaacagcatataaaacggcagaaaggaacagggtgattctgagtgaccaagagtttaggaatggagaagtgtgaggtgtttatgaggagggcaatgaatgaggctggagagaggtaagtggcaggcagatcgtggaaggatggtacactgtgttgagtatggattttattttaaaggtgatggaatcactgaatcactttggggaatagcattattcaacgggtgttttggataactcattggcagttgtatggaggaagaatttgaggagtcagttaggaggctgttagagcagttcagagatgagatgacagtagcctggactgaggatatgttcatgggaatggagaaaataaaatggaatcaagagatgtttgggatgtagagtggataacacttggggtggtgtgtgtgtgtctgagagagagagagacagaatgagagagagagagagagatgagagagatggaagacatatatgttagggaactctatgcagcatttgtggctctgaaggtttttatttggaaggtgttgattgaatctgtctttttttctgaaaacttcagcatgtacaagttgctgacttattggctgtttttaaaaacatctgaattctatatatacttctgagagtccattacatttttcttaggtctaggacagcttttagtttccagactatcaactgtgtgggtggtgattccactaattgagagaagggaagataggcaaataagtagaatgatgagtttgtaaattgtgtttgaggtatctttggaatatctaaagaaaatttccaaaaggcaattggatgtgaaaaaattgaagtttgagaagtttgggttggagttatggattttcaagtcagtagcaaaataggtgattaacgagttcatggtaatagacaaaatcatcccaggagattatttagggcaaacatgatagaaggccaaggttgtaacactaattgagaaaaagaaattataaaggtaattgagaagtgtctaaggaggaaggggatgatatttagactgcagaggccaagggaaggggtggtttcaaggtgggagtggacagtagatttagaatgtctcagatcatctaagctaggagcctgaatttatcctgggtatgaaggaattggatggtcattaatgacagcagttttaatggagccagattgtaaggtgtatcagttaggaatgagtttggctgcaagttaaagaaaacctaaccatagtggcttacagatctaggcttatttttctcatctagcatgaagtccagagatgggaggctgctggtgtttgttcaagaacttaatgatcatcagggtcttcttgcaattctcgaagcttattccttataatctcaagctgattgatgcagcctcatacatgttcatgttcaagataggaagaagggaggaagagtggcatcttcaaatcaggaaaccagtaatttccaagaaatccccacctgcagctaactacttaggtctcattgcccataatgagacatatgactacctgtagtcacaaggaatgctgggaaagcagggaatgttctggcatagtgatcattgcctgggctgggcccattgacactgtatgcaaaatttgggttctgttagtgaggaagaggagagtgtttattgagtggccagctaacagtgttggacttacataggttgagaaatgaatgggaagtgagaaaatggggacagtccatgtctatgacaccttaagaggcagttctgaggagtatggactagaaagggtggtagccagagtagaatatggggaaataatggaaggttacattctagaatatgaaaggcttgagtacatgtaaatgttgatgtgagtgggagagattgaagatgcaccggagctttcacaccccaggacaatacctagagacttgggatgggtgagggctgtgcttttctattgtaaaatggcagaaggggttcatataggagcttctgaagacaaatcggttaataggaaagagcatatacagaggcttaggatctggaaatacagtcatttaaaactatccatgttcagtatccatgtgtttccagtttaaagactactgctttaaatcatataacagtttctgttcagtcattagcatttccagttctatgtgataatcacaagttgaatgctgacttgatgttaattttctccccctccccagctagggttggcctcgggtagggcattgccacagggagggtgtgtgctccctttgagtctcttaccccagagtttcttgccctctgggtttggagtgtaggatgaaaggaggggaaagtggggcagggaagtttctgtttctttggtgattgcagtatggctttgatctctctggtccctggcaggtgttcagagctgacttattcgcaggtgtcccatttccttgctgagccaatttgtcttccctctggttagtatttacttgactcatgcaatgtacgtttttatttctggtggtactaactttttaaggatcctcttgggaagtatctccttaacttgggactcacttctggtcccagggtttaccaggctttgatctgccttgatgtttggggtgctgtgtttcaatatgttcccatagattgtgttggaagctcaattgctactgtaacagtattaaaaggtgggcctttaggaggtgattaggccatgaggtcttgctcccgtgaatggagagagtttggcctctattttctctctatctcatgtgctccctcctcccttctgttttctgccatgggatttacccttgccagatgctggtgccatgctgttggacttactggcctccaaaactgtgagctaaataaatatcttttctctataaattacccaattgctggtattctgttatagcagcagaaaatgggtcaaaacaggagtggagttacttctagtgcagcagtgtctctctgtcttcccctctctctccctctctccctctctccctccctcttgttggcttaggccgaaagattcgaaacctttgtgtctatgtatttttaaaagttcacagatccattgacctgattctgatattcacaggggctccctacagaccaagcaaatttaatgggaaaagaacacttgacttcataaagaagaaatttaaaatatattttataagaaaaatgaataaaatttaagaaaataaaaattaactccaggtcctaaaaacaaaacattcagaaaaatagttacctacttctgttcccctcagacttgttctcagcaacattaaatgccagaaagcagcagaaattgcaatatttccagagtattgaggaaggaatagaatgaccctcaaataccatacttagcttgatgcatagaaggcactaattttgttgttgttgttaaacaaataccagaatgcaaatgtcttttctctggggatggttgcagaaaagtatgtgtaactcattgtacttttgtaaaagaaaaacatgtgtttgtatatgtaaatttaggaaaaaggtggaaagaattgtctcagactgattaaacccaggaatggagggaactttacttcttaattcttataatgaagtcaaagttttaataaaatttggtaatattttacattttgtattttttagtttttgaaaaataccatctatgtaaaaaaaaggcaaacactatcatagatcaaagcctaattatacagtttttttatttaaaacaagctgttcttgcatattcattaaaaaaaaaactcaggtatattatttgtgccagaacagtctttagacctatatttattggtgaactttaagaataaaacattgtcagcttcaaccttctatgtccttttaaaggtgattaaactttcctaggttggacaggatggcttgaggagaatgacgtacattaatttttctagccaaattatttcatgtggctcagaacccattcagtcattctattatacaatctgatcttttaaactcatctaaatagctactcgacattgtccttatcaggcctaggtcaatgataaaggtacataacagaataaatctccctaaaggaagaaaggaaaagattaactctctcccaaatccccatgaaacttcatgttcctacatggacctgtttgtagtctggtccccagacactgttgagatctgggaacacggggtcccagaaagaaagcagccttcatgattaattcactttcaaaggttctgccttaaccattcagggtgttctaaaaagaatcttctgaaagaccacattttgctatgaaatcaatcaaaaacaaaataccagtcagaatcaaactttttaaaaggtcacactcatagaggcctccaattcatgatcattgggtacatgttgacaagctttttaggaaactttagagatatatggggaagatatcaatctcatctgtcaactgtaattgaaaatgggcaaaaaaatacaaatatataaaaactggcatcagtgctggaaactagagaagggcattgcccaacttggagaagttctgcctgatatgatgcaaactgtaggaagccacatgggccaaatcgtagacatcctttctgaaaaaaagataggatatgcaaaaagtgaatacaagtaaatcctaccagaccaggctgttactgcgcagctactaatttctatgtgtgagagctcagaggggtcagcccctgtacatattgggaacatttattctagttggaacccattttcccagagtgggtccacacttacaatcatttgcaggaagcccaaagccgagcctgaggacagcaagactttttctggatatggtggacagggcatccaggaagtgtggggtcctgggcacactcagccaagactgggtggggccaaacctttttctgtttcctgtctcatgttcttgtgctgggacatttccttgattctgcctttttctttttcttttcttttcttttcttttttttttttttttgagacagagtcttactctgttgcccaggctggagtgcagtggcacaatcttggctcactgcaacctctgccttcgggttcaagtgattctcctgtctcagcctcctgagtagctgaaattacagggatgtgccaccatgcccggctaatttttatatttttagtagagatagggtttcaccatgttggtcaggctggtcttgaacttctgactttgtgatccacccaaagtgctgggattacaggtgtaagccaccatgcccagccaactctgcctttttaataagcaattctgatttcagttttgtccattctgtgctcactcttttttattgagttttcctcctttcatttttcatggtagccttttcttgttttgtgcatatgaaatcgtctcaaattttcctattaggtattaatgaaaactttaaaaagttcccctctatactttgattatctctgtttcctttggatcattctaaagtttcctctttgacatttcctgtcgcactcctggttttcctaaaatttctgtggtttctgattgtcagtgtatcagaatgaaggactagacccatcactgtaggtagctggggtaggtttttgtctgtttacctcacagtcttccctccctactggaaggactgagtataggggtgggtgtggtgatcagttttatgctagggtcagtggccaagggggactcagggaggctggaaagaagggttttaccttggaatgcagggctttgctcttgggcagggctgcctcttcatgttgccccttctgtctgttggaatgttgggaaagatctctagcttctctcagatctccacatccactttggggccatcagcaaagtccactctctttagagtgtgggtacagtcttcagcctggggacaaatgccccagttgcctgttgcttagttgataatattaatggctaatatttaatgagacttaacagtgtcagatactgttctaaatactttccatacagtaatacttacaaggcagatactgttataatccacattttgtagataaggaattggaagcacagagaagttcacagttgcagtggagcagagatttccaatcaaggtgctttaactaaagaatttgcctttgggtatagagatggcgtgtggggatgggggtggaggggctctgttgatccttattgctttccaccatacagttattttattaagtcccctgatgattccccaggctcactctgttctttttatttttacattgtttagacttggaatttctctgtatcaacttttatcttgggagcagttttctactatgcatatattggttggctttatcctcagctctctaatcccatctgctctctgtcttctaggaatttctcaccatttatgatctgtcactggcaccctttcttgtttttcagccctgttatagatgttatggatatgcctctctctctatagatatatctatatagatatatgtagagaggaatgtggtacacagagaagatgtgtgtatttggtccgccatcttgattcaatttctgtaatatttattatatgtgttttatcgatttacttcctggaagtgagattaattaattttttatcgtgctgctataatgattaaattttgaagtagcatttagcgtgcagggagtacagtcacaatgtaatagcccctgggatttttgttctcttgagtataggttattagactctgtatggctttgttgtgattctgctaaacagagacttccagatgcggattgtcagacatgaacattatttctactattcaaacagatagggacgaagtggtccagcattgcttgttaaacttccttctagaagaataaatcaggataaatgcaatcaatgtaaatattaaacacattgaatgcagggcttatggaaggggtagtttaatattttaaaaattgaaataaaatgtacatataggaaagtgacagaccacaagtgtacagtatgatgtattttaacaaagtgacacattcatgtgatcagttcaagatatagaacattagtggcacccaagaggaccccttataaccttaatttacaagtaactaccacaccagcttcaatcaccatagattagcttttcctgtttttgaatattgtatgaatggaataatgcagtatgttctcttttttgaactttatgtaattagacataaatatattgagcttctttcattcaatgttatgtctgaaatttacccatgttgttacatattatgggagcagttaattctttttcattataatactatatagtgttgtattgtagaaatagccacaatgtaattattaattaatatgggcatttgtttctagttttttgttattatgagtaatactatttttacatggattttggtgcacatatgtaggaatttctgctgggtagataccagcagaattgctgagtcatagggtatggttatttttatgttcagctttagtagattctgccaaactgttttataaaatagttgcaccaatgtatactcctacaaatactgtatgagtgttccagttgcaccattaatccttggaaacacttgtgttgttgttgttgttttaaagtaattttgaccattctgatagtaatgtagtggcatctcattgtggttaatttgtatttccacgattataattaggtgaaaacattttcttatgcttattggccatttggattattgtcttagtccttacaggctgccacaacaaaaataccatagactaaatggtttaaataacaaatatttctcatgcttctggaggctggtaagtccataatcactgcactaccagatctggtgtctgataagggccttcctggttcacagatggcagtcttcttgctgtgtccctgtatggtggaagagtgggagagctttctctgaagtctcttttatatggtcactaattccattccagagggatctataatacctccatggcctatcatcttctgaagactctacctcctaatagtatcattgggcagttagaatttcaatttatgaattttgaggggacgcaaacattcaagccatagcagaaatcttctttttgtcaaattgcctatacaaggctcctttgactgttttttaaaatattgaatctatttgcctttttcttcatgactcatcagagttctttttaatatttgaatgtgattctttgtcagatagatgtgtggaaaacatcttctactctgtggcttgatatttctcagtcttctcttaggtttaatgaaatacaacatatgaatccttttcttgagagttagtattttggggtctggttgagatatcttctatcctagggttatgttatcttgtagatatcataagattctaaaatctttaaatttttaccttaaacattattttaaggtcagtgaggaattatttttgaggtatggtgtaaagcaggggtcttaaattatttttaagaatagaaaggatacctgaaatcagagaatttgagaactggtgatttaaagctataaaattcccaaacaacagctttagctgcatctcgtaagcttaggttatatctatatatttgcattccttatttaaaaatattctctaatcttcatctttgactcaggctgtttatgcatgtgttgtttaatttccaaataattggaacattttcagatattgatttctatattaatttttatggtcagagaacctactctgcatgattttggtctttgaaattttagaaatgtgctttgtgattccgcatatggtctattttggtaaatgttccatgtctacttgaaaataatcattattttgtagttatttgctacagtgttctacatatgatggttcaagtcatgttaatctactgattgttttcgtctgcttgttttataagttgctgaaaggtgtattaaaatatttaaaaatatttggaattgtttctagttttagttttataagagtatgctttatacatcgtgaggctgtgttactaagtgcttaaagatttaggattgttatgtctcttttaaattgactttttacaattgtttaaatgttctttattctagtaataatgttttctgtataaaagtctattttgtaggatattagtatagattctaaaggtttttattgttgatgttagtgttttctttttttaaatttaaaatttctatgggtacatagaggcgtaagtatttatggcatatatcagatatttttatacaggcatacaataagtaaggattattacaatgtgtaatgattgtcagggtaaatggggtattcctcacctcaagcacttatttctttgtgttatgaacattctaattgtacttcctcagttactctaaaatgtacaacaaattattgctgactgtagccactctgttgtgatatcaaatattatctcttattcattatatctgactatatttttgtgcccattaaccatcccgattccctctactcccctgctacccttcccagcctccggtgaccatcgttctactctctgtcttcatgagttcaattgtttaaatttttagttcccacaaatgagaacatctgatgtttgtctttctgtgcctggcttatttcacttaacataatgtcctccacttccatctgtgttgttgcaaatgacaggatctcattcttttttatggctgaatatgtaccacattttctccatccattcatctgttgatggacacttagattgattccaaatcttggctattgtgaataatgctgcaataaatatgggcagcagatatctctttgatacactgatttcctgtcttctttcctagcagtgggatggctggatcatatggtaattctatttttttttttttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggtaattctattttttgaggaaattccaaactgttctccatcgtggttgtacatccttaccaagggtgtatgagggttcccctttctccttgccagcattcgttattgcctatcttttggataaaagccattttaactggggtaagatgatatgtcattgtagttttgatttgcatttctctggtcatcagtgatgttgagcatcttttcatatacctgctagccatttgtatgccttcttttgagaaatgtctattcagatcttttgctcatttttaaattttattattagattctttttcctatagagttatttgacctccttttattctggttattaatcccttgtcagatggatagtttgtaaatattttctcccattctgtgggttgtcttttgactttgttgatgttgaaaagcctttgctatgcagaaactttttaacttgatatgatcccatctgtccatttttgctttggttgcctgtgcttttagggtattactcaagaaatctttgccaaaatcagtgtcctggagagttctcccaatgttttcttatagtagtttcacggtttgaggtcttagatttaagcctttaatccattttgatttgatttttgtatatggtgagagatagggatctagtttcactcttctgcatatggatacccagttttctcagcatcatttattgaaaagactgtcctttccccaatatattggttcttggcacctttgttgaaaaggatttcactgtagatgtatggatttatccctgggttctttgttttgttccattggtctgtgtgtctgttttttatgtcagtatcatgctgtttggttactacagctctgtagtataatttgaagtcagttaatgtgattactccagttttattcattttgctcaggatggctttggctattctgggtcttttgtgattccatataagttttaggattattttctctatttctgtgaagaatgtcattggtagtttgataaaagttgcattgagtttgtaggttgctttagtaggtatgaaattttaacaatattgattcttccaatccatgaacatgaactatctttctatttctggtgtcctcttcaattttttgcatcaatgctttatcgttttcattgtagagatatttaacttcttgggttaattcttaggtattttatgtaatttgtagcaattgtaaatgtgtttactttattgatttctttttcagattgttttttgtggacatatagacattctactgatttttgtatgttgattttgtatcctacaactttattgaatttgtttattggttctaatacctttctgatggagtatttagatttttccaaatataagatcatgttatttgcaaacaaggataatttgactttttcctttccaatttagatccctttttttctttatcatctgattagctacttttttttctttatcatctgattactccagtactatgttgaataacagtggtgaaagtgggcatccttgtcttgtcctttatcttacaggacaggcttgcattttttcctcattcagtatgataccagctgtgggtctgttgtatatggcttttattgtatggagatatgttccttcaatatccagtttttttagggtttttataatgaagggacattgaattttatcaaatgatttttcagcatcaattgaaatgatcatatggtttttgtccttcattctgttgatatgatgtatcacactaattgatttgcatatattgaaccattcttgcattcctgggttgaatcctacttggtcatgatgaataatctttttcttgtgttgccaaattcagtttggtagtagtttgttggggatttttgcattgatgttcatgagatatattggcccgtagttttgttgttgttttgtttgtttgtttgttttttgatgtatctttgactggtttaggtatcagggtaatactggcctcatagaatgggtttggaagtcttccctcctcctctattttttagtataatttgagtaggatttgtattagttcctctttaaatgtttggtagaattcagcagtgaagccatcatgtcccaggcttgttttgccagaagactttgtatttcaaacgagatcaaatgagaggtttgatcttgttacttgtcattagcctattcagactttggatttcttcatggtttaatattggtaggttgtacgtgtctaggaatttatctgtttcttctaggttttccaatttattgacatattgttgctcatagtagtctctaatgatcctttgaatttctgtggtattggttttaatgtctccttcttcatccctgattttatttatttgggtcttctctctttttcttagtctggctaaaggtttgtcaattttgttcgtcttttcaaaaaaaccaactttttgttttgttgaccttttatattgccttttctttttcaattttatttatttctgcctgattttaatttttttttctttactaattttgggtttggtttgctcttgcttttctagttctttagatgcatcattaggttatttatttgaagtttttctacttttttgatgtaggggcttattgctataaattttcctgttagtactgcttttgctgtatcccataggttttcgtatgttgtatttccattttcatttgtttcaaggaattttaaaatttccttcttcatttcttcattgacccactggtccttcagtagcatactgtttaattttcatgtgttcgtatagtttttagagtttctattattgatttctagttttattccattgtggtcagagaagacacttgatatggtttatccttgagaatgattgctgaggagaagaatgtgtattctgcagctgttggatgaaatgttctgtaaatatctatgaggtccatttggtctatagtgcagaataggtctgatgtttctttattgaaatgctaatgagtagtttacacaccacaattacagtgttattatagtctgtatttgtctatgtacttactgttaccagtgaattttgttccttcagataatttcttattgctcattaatgttcttttctttcagattgaaaaactcccattagcatggtgagtattagggagtgaaaagctcccattagcataggtctgatgttgatgaaatacttcagctttcgtttgtctgggaaagtctttatttctccttcatgtttgaaggatatttttgtaggatacaatattccaggataaaatctttttccttcagctctttaaatgtatcatgccactttcttccagtctgaaaggtttttactgagaaatctgctgccagacataatggagattctttatatgctatttttttcttttatcttgctgcttttaggatcctttctgtattctttacctttgggagtttgattattaaatgtcttgaagtagtcttatttaaattaaatctgcttggtgttctataccctttttgtacttgaatattgacatctttctccaggtttggaaagttttctattattatctctgtgaataacctttctatgctgatctcattctctacctcctctttaaggtcaataactcttagatttgcccttttgaagctattttctagatcttgttaggtttgctctattctttattattctttttccttttgtctcctctgtgtattttcaaataggcttgctaattcattcctctgcttgatcagttcttctgtttagagactgatgcattcttcagtttgtcagttgaatttttcagctccagaatttatgcttagttctttttaatgattttaatctctttgttaaatttatctgataggattctgaattccttcactgtattatcttggatttcattgaacttcttcaaaacagttcttttgaattctttgtctgaaaggtcacatatctccatcactctagaattggtcactggtaccttatttagttcatttggtgaggtcttgttttttctggacggtcttgatacttgtggatgttcattcatgtctgggcattgaagagttaggtatttattctaatcttcacaatctgggcttgtttatacctatcattcctctgaaggctttccaagtattcaaagggaattgagcatttgatctaagtctttggtcactgcagctatatgtgcattagggagtgccctaagcccagtaactctgagtcttgcagtcttgtataggtgctgcctcagtggtcttgggtaagatctgggagaattccttggattaccaggcagagtctcttgttcttttcccttactttcttccaaacaaatgcaatctctctctccatgctgagcttcttggagttagtggaggggtgatacaagcactcctgtgaccatcactgctgagattgtgctgtgtcacacctgaagccagaacagtactgggtcttgcccaagatgtattacaactatttcctgaattctgctgatgtttattcaagggccaaggactctttagtcagcagaagttgattcctgccagaaatggatctttcccttcagggcagtggatttccttctggcccagggtggatctagaaatgcagttcaggagctagggcctggaactgggggctgcaggagtctgcttgatgctttactgtactgtggctgagccgctacccaagttgcaagacaaagacctcttttttgctctcctttcctcaagcagaaggagtctctgcccagacaatcactgcctcaggcccatggcaactatagcttggctactgctgatgtttattcaaggcccaaggggtctttattcagcaggtggtgagttctgccaggtctgggtctctcctttcaatgcagtgggttcccttctggcccagggtgggttaaggaatgccctccaggagctaaggcctggaactgaggaaatgagaaatcctcttggtgctttagtttactgtggctctgctggtacccaagtcacaagatgaaatcctttttacacttccctttcctttcttcaagcaggagcctttccctgtggatactatagctgagaatgtgctgggtcacacatgaaaccagcacagtactgggtcttgccaaggcctgtgatgactgctgcctggctacagatggtgtttattcaaggcccaggggtgtttattcaaggcccaagggctcattagtcagcaggtagtgaattctgtgacactgggtcctttccttcagggtagagttcttttctggaccaggatgggtctagaaatgttgtctggaagctatggcctgaaatggggtctttaggactttgcttggtactttattttactgtgacggagctggtatccaaattgcaagacaaggtcctctttacacttccctcttcttacagaactgtgagccgcattgcctggagttggggaaggggtgatgcaagcactcccttggccactccagctggtgtatccctggaaagttctctattaataaagtttcctgggttgcatgcaccccagttccactggctgtaggcccagcagagcaccagtatttgtccaggaattgcagtccttgtggcctagactgcctttcaagtttatttaggaccccagaacactttatcccacagtggtggggctagccagaactcagtttctgactgctgggatggacgattgccctttggctagggctagtctaagtgctccctccacgggcactggccaaagccagtgggaaacactaggaaaggcctgtgttgctttccactgtgacagggcagcactgagttccaatgcaaattccccaaattactttgcccttcctcccgcaagtgcacagattctctctccatgccatgctgcactgctgggggatggaggaggagtagtgtcggcaattcaaaactatcattcctatcctcttcagtgcctctttcttggatacagagttaaaatcaggtgctgtgattgctcacctgatttttggttcttatgaaggtgatttcttgtgtggatagttgttctatttggtgttcctgcaggggggacgattgctggagggttctgttgagccatcttgctctgcctcctcctccagaaatcagtgttagtgtttttctgatgtatctttttgcacctgtttatttttctttcatgttattacctttagtgtgcatctcttattagcaggatatagtgtagcttttttttttttttttaaatgctggctgatgcttcttgtcttttaattggaatatttagtccattttcatttaatgtaattattgatatttttacatttaaatctgctatgttattatttgttttctatttatctcattcattctttgcttctttctcctttcttgccttcttttggattaatccctttaaagaattattccattttactactctagtagcttgctagttatatattattttataattatttaaaaagcaatactagaaattataacacacttttttttaatgtggtggtgtcttcattaaattagtactgtatcacttccaagcaatagaatagaccatacaacaagagtctcacttaactcccttagtggtggcttttgtgctatcatttttatgcttttgaaattctacatacatttaaaacctcacaagacattacttttattttaagctgtgaatattcatttagatttatctttctggagctcttcatttctttccctattttcttatttccatttgtttccatttatatatgtgtgtgtatatataataaaaaattatatgtgtctgtgtttccatttatatatatttatatatataaattcacatatattacataaatgtgtatatatataatacatacacactacatatataattttttaaagaactccctttagtgtttcttttggtgtttgtccgttgtgagaaattctctcaatgcttttgtctgaagatttctttgatgttgcctgtttatgagggatatattcattgacagggaatagaatctaagattggtagatattttctgccagcattttaaagatgtgatttcattgttttgtagctccttgatttctcttgtaacatcagctaagaatctttttgttgctcctttgaatgcaatgtgtatctttctctttgtctttggtcttcagcagtttgactataatgtgcctaggtatgtttatcttcatatttatcctgattggtattcatagagaagtttcaatctgtagcttggtgtcttttttctattttgaataattattgtccatctcctcttcaaatattgtttcttttcatttctttgaactctaaaatacacttgtgttaaggtattttcaccatgtctgatgtgcttatagtgctcttttttgtgtttttcatcttctttccctttatgtttcaatttagatactttctactgactgaacttccagttcacatattctctcagttgtcgtctaattgttattaaacacttctgttgggttcttaattttagttattggattttcatctgtaattttcatttgctttctttttatgtattccaatttttgataaaaattttacattgtcatttattttattcaacatatttatcatagttacattaaaaatcatttctgatgtcaatactgggattacctgttggatcatctaattcttttcttagttttccattgttggttcagtatcctggtatgccaaattatttttatttgaatggcacatattgtgtgtgaagaattgtagcaggtctgagtaatgtatcttcctccagagattatctagttttattctggcggataatgagggtaaaggcttgtaaccttgctacaggtggattgaaatgattcaagtttgcattccaggctttgtgagggcatgtccccttgcttgcttttactcctagggtttaggcattcagggatgaattaaaatcccagatgtttttccttattggggagtcctgactccaatttctgtctcttgatcactgtgatactgcagaaatacctgcttagatatttagccttctagcagcctctttgtgctggtttcttatcatctgccttgtgtattcagcttaggaaatgtcaaaagcctcaagaggaaattgaacatagcttgtcaggtttgcttctttatgtttccctttttcccagaaatttggcctcttatatcctggtttccttggttacagtgtattccaatttttctcttacacaacctagtaagactgctgcaagttccaggctggtgttttctgctcagactttatgtcctatgttgcaagacagaacatttcctaaagagaacagtcagctgtagatgtatcactcccctcaatgcatttcccttcctccagattttggcccctcagattgtggctgtcttggttgctccgatgacctcaagatctctttaaacttggaaatttgaaaaaattttagacttacagaaaaggaagttgcaaaactagtacagagagttcacatatacccttcactcgtctttccctaatgttaacaacttacatattacctttactattgatacttaaaattgtgttgccatgttctccaagctgataacaacagagcatgactgccaactggttgaaaggagaaaaaggaacctttcaaaagggtgacatttttggcacagggcttctcaaaatgtgttccttagaacaccagtccttggagattttcctattagacaacgtccacagcccagtaattgtaggaaatgccacatcttacatatatgtgcccctttggaaatccacagtgcccattaccattttattttatttattttttttgagatggagtcttgctctgtcacccaggctggagtgcagtggtgtgatttcaactcaccgcacctccacctcctgggttcaagtgattcttgtgcctcagcctcccgagtagctgggattacaggtgtgcaccaccatgcctggctaatttttgtatttttactagagatggggtttcaccatgttggccaggctggtctcaaactcctgacctcaagtgatctgcctgctgtggccttccaaagtgctgagattacagacatgagccactgtgcccggccctccattaccattttaaagcctctgaaaatgtttcagtaaagaaatctgcttaattttgttttccctgtgtttccaaatatatatagtcaagagctgtttttgtttttgtttgtttgtttgttttactttgcctggcccttaggtacatcccatggagctagtgttttgtggcacacatactggaaaatactattctggagcattttctaaaatcctaagttacaaattttgcttttttacattttctcttaggttccggctttcttgctgtttaatttcttgcttcatgaaagggaagaagatggagacgccaaggtttctttgaaaacagatatttgcacgagaaggcagccaaggctgtgttaacattcaccattaaaaacccaacacatctagacaaaacaccaaatgcaaaagcttcacgtttcccaaataaatttcttttataatttgtcactgctcggttgtaggctttgaaaatagttttcattttcctgttattgacaaaattaaagctgccaagaagtagatggtgaacaaggattttatctctgactgtagcaccaaggcaacctgagataggtctaatttgcagcataaatcttcttttccactgggggaagaacacacgagccacattgagtagccacccatttgtatttttgatttgcaacttctgtctagtgagccaaggtcaggtgcgatatttgtgatggggaagctgaataggtgagtgagggtagcttgtgtttgaagctgaagaaggtaattaagagggttttagaatgtaattttggcatttttccccactccacctcttcaaactatgtgtcccctgtcatcgcctaaccgatctgcctgtccaccttctggttcctctccagtccattatctcatggcccacttgactaatctttctgaaactcagatctgttcttatcactcacctttctaaaagtctccattgtccccagaattaagtttagccccatggtctggcccctgagtgtatgcctgtctgctccttttcatttaagcttctgttacccttgctgaattattatgctgtttcctgttatgttgtgtgcatctcttagaagctgcatatagctggattttttaaaatccactctagtattatttagtatgttgaatgtaatccaattgtgtagataatcattactgatctatttggactctctattttttaatcagccatttctttgcttatactattctttctgacagaaatgccacttttcttcttatctccctggtgaactccatatatcctactaggctttgttctggaactttcttggcaccttctcatttatataattgcttccttccatctgggttttaatggcaagttctgcatctctattacagaatagtattgatctcattgtggattgctgtttgtgtttctgctttccagtgggcctgtgagagtgactgatctttgcatctctagcaaattggcacagttggtagactttccaacctgagatattagatgtttcagaaattagattgaatgacgtggtgtcagtttgaaacattaaattgaggtgttctttgaaatgtatttaaggttatacaatgatttttgaatacagctttagctgcataccacagattttgatgtataatatttttattgttgttaaattttttggtaatttctattggggttttctttttaatctgttatttaggacagaattttaaaattttgtgctgatatacttatttttattgttggttcctaacttaattgcattatggttaaaaaaccccaaaacctaataaacatgctctatatggtattgattgactttgttacgtagtattaggttggtgcaaaagtaattgtggtttttgccactacttataatattttgcagcaacataatatatggtcagtttttgtaatgttctatctgtacttgcaaggaatatacattttttaaatttattggctgggggatataggtatatgtgcataatagttgaccaaggttattattttggtcattcagataatcaatatctttttcaattttttatcatgtttgatatgtcagttttctgatggagttgtgttaaatctcctgctgtaattgtgggtttatcagtttcactatttcagttttgctttatattttttggaggttatactaatagtggaaacaatatcattattataaaaattttggtggattgctccttttattattacattgagtctctattcctattaatgctttgccttaggaaggtatttcttaggtcaggcacagtggctcatatctgaaatcccagcactttaggaggtggaggcaggaggatcgcttgaaccttggagctcaagaccagcctgggcaacatagagaaaccccatctctacaaaaatacaaaaatgagccaggcatgatgctgtgcacctgtggtctcagctactcctgagatcacaccactgtactccagcctgggcaacaaagcgagaccctgtctcaaaaaaacaaaaaacaaagacaggtagctcttgtctgatattactgctgcaggctttattttgattagcattttcctagtatgtacattttgtcttttcagtctttctatgtgttgtgttttagttgtgactcttagaagatgtatatagctagattgttaaaattcactctattattatttagtatgttgaatttaatccaattatatagatgatcattactgatctatttagacttattactatctgattttgtggtttctgtttgccattccttcttcctccctctccctttattctcccttgttttcttttggattgaaaaatactggttttctaacagtgtgctggtatggatactatgttataacatgcatagttctatatgggtatcatagttttgtgtttttaggagttaccattagttatataacacagatacctgctgtgcattattgtaatgatgtctaaagttatacccatttctcacctcctcctgaacacacatgaatcttagtgtgcttgaaatatccactcaacacccttccccatttctgtgttattattgctgaaggttttaattttgcccttgtgtaaactcagacacattggtttttgcttgtttgtttgcctttactcaatggtaaatttaccaccatagtttctcaatttttattctcaccgttgtttcctatggtccatactttccctcttggttcggtttttatttccttgatgtaatactttagcatcactgttatttgagtctgtgaagtctgaatatgtctttattttctttctctcgctcttttttttttttttttttgagacagagtctcactttgtcactcaggctggagtgcggtggtgtgatctcagctcattgcaacctctgcctcccgagttcaagtgattcttccattctcccacctcagtcttctgagtggctgagattataggcacgtgccaccacatccagctgattttttttttgagacggaatttcactcttattgcccagactggagtgcaatggcgcgatcccggctcaccgcaatgtctacctcccgggttcaagcgattctcctgcctcagcctcctgagtagctgggattacaggcatgcgccaccacacccagctaattttgtgtttttagtagagacggggtttctccatgttggacaggctggtctcaaactcctgacctcatgtgatccaccacttcggcctcccaaactgttgggattacaggcatgagccactgcacccagccttgctcttaaacaacagtttagggagacagaaaattctagatttttattgcgccaccacacccggctaatttttgtatttttagtagagacagggtttcaccatgttggccaggctggttttgaacacctgacctcaggtgatccacccgcctcaacctcccaaagtgctgggattacaggcatgatctgtaatcccgtgcctagccgatttcttcttaacactttgatgccattccttcattgtccctggcatctgctgttgcagaagagaaatctgctgtcaatcttattgttgctttggatgttttttcccctgcgatagttttaggattgtttatttttgaggttttgctgcgtctgggtgtgaattaatattcatcttgcatggtacttgagtgtgcttccaaactgtagactcctattttccttcaattacagaagataaaagagccattttacttgtaaatattgattctcctatattctgttgtttttttctggagtgcctgttggatatatcttggaatctctcacttatccttcatatctattaactgatatttccttaaaaaaactcttcatctctgtttattttatgttctttaagttccttaatattttccagcttaccagttctttcctgattgcgcccaggctggagtttgtcccatctattgggtttttcatttttatgactatataatactttttgtttctaatgttttatgtctatcttgaaaatttcttcccttttgtataattgtttgctcttcattaatagaagttattcctttatctatcattttaataatatcctaaacacacattaaaaagtctatattgtttcataaaaccgttttctctagaagtgaattcatgttatgttatgtgattttgtcggctctctttcttggtgttatattttattcatgtgccttggaatttagatctaggatgaattttaattccaacttcttgtgctcacttctctctagtgattgtggcttcttccacccagcttcccaaggccccagtacaaaaccgtggtttctgttctgtggtgatattggggctatctggatccagtcacagagctggagggggtggggatgtgacttgactgattctttgttcttcagtctccttgggcctgcagattgccacatgtggtagcatcagacaggggtttacatctgaattttttttcccagcctcatttgcttttccatccccagctgtaagcagaacttgaacccagactctggtctcatggagcacttttagatccttttgtactcagcaggaaccagactgctggctgtcatagcctgtgtgcaggcaagaagcccagcaggcccgaggcttcaaccttgttcatcatgttgtgtttctgttcattttcagattcacaaaaatgtttattctgtttttgagcattgcttatctttctggttttctttttttgatatttaatttatccttgctatgtattcaaggcataaagagtgcatattttgatatttaatctatccttgatttgtattcagagcatagggagtgcatcggagttgaatttgaatagtcatcttcaccagaaatagaagcttgagtatttatatttagcttccagcacctagaggaaataaccttgtaaccttggaaggaggccaggtgccctgtaggaatcacgtctatctttttttatctttctatcccaagtaccagtcatgtccctgcacatagtagatgctcaacaaacaatatttgttcattgactgacctctgaaatataattacgtggcctaaacagctaatgctatatgtgtatttatacttaatgtatcaaaacagtaaacaccactgggaaattcaggaaaagcagaaacgaatgatcatgactcttaacctgtgactcctgttgaaaatgatcccatatgttgtcttttcaaacaagatatattcatgtcactagtttctgttcttgaaagtagaaacactactccttctattagacattttggtttctgaaaatagaacaagtaaaacctgaacaagtgcgaactcgttcggattaaagggatttcgggtccaactctccaagccaaagggattttcaaatggttattttaaaacgtggatctacatgtgggcttctgtggtttcaatagtcacaggaaatgcaggccactgtatcagtcagcttttgctatataacacaccatccgaaaacacagcgacttaagacaaaaaaaaaagttcatttagtttatgattctgtgggtcagcaatttgggctgggagcactgggtgggtggatgtgctggtgtggttgatcgctgctgggctcactcacctgttgccggtcagctgccaggtgagctgagggcttgatggcccgaggttgctcaggtgggatggctgatctctgatccacgtggtctttcattctccaacaaggcagcccagacttggtcaggtggaagcagtcacagcggacctgacagagtgagcagaagtatctgtagagcctctttgtgagtactgatttggaatttatagctatacagtgtggtttacactcttctattggccaaagcaagtcgaagcgtggaaaaatagacttcttaatgagaggagctgcaaagcctgtggccacttttgtactctaccatggcaacaaaacgtggaggtgccactccccaccccaggagagattgtgtaactttccttagatcctcaggctattacctccaaagttgagaaccaatatgttggatgatttcactactgaacaacaacaatgaaaatgtttaggagagttaactgatggacacatctgttaaaacactgcttggtgtgtggaaatgaaatttttcattttttctattggaagttatgccttgtatcaagacattaggttaattctctctgacttctgtactcagcctgaaaagtaaggattcttgttcagtgtaccagataacttctattatgtggcaaaccactccaaaattcagtggtttaaagcaataccgtttattggactcctgttcccatgcctcagcagatggggctgatctcagctggggtctctcacgttactgcagtcacctgcaggtcagctgggtggctctgattctggggatggactggttgtaccttggtgggtgtctgggccacttgtttctctccattcagttaatttgcctgggcttgcttgttcacagggtagcaacagtgtttctagagagtgagtagaagcacacaagatctcttcctgcctagctaggcttgtttctgtggggtcaaaacaagtcacaagcccagcccagattcactaggtgggaagatagactccaactctagctcggaggaactgtaaagacgcaggacagggaggatggagaaccctggccattttgtagtcttctgtatctgttgtcttcaagaaattccttctcacacttcgaatttaagtaaaatactatctccacttatatttttcctattaaatagtaataccgcatgtgtaatagtagtagtaactacacttgtatttaaaacaacctgccatcttttcacctttaattgatggcacctcccttactgtggatttgcatattcatattactattttaagggcgtagattatgttaatgtgttttgctaaagaaaatgattgaacttattttcttcttccaatttgtcttcctcgttctttaatccaaccctactggtgccagacttgcttttctaaagggtttctctgtgtttgatgaagactctttagggatctctcactcgtactctttagcttggcatttgagaatccctgtgctctgggcgttgcgtaactttcagattttattttcctccattcttccttgtgcactagttttcacagttaaacacaatttattgctgtttttttttcttagcacattggccatacacaaattgtcctcagctcttgggcaacatttttggttgttacaaccgtgtgtgtgtgtgtgtgtatatgtgtgtgtgtgtccatgcttgtagtactggcctttagcaagcagagaccagggttgctgttaaacatcttgcagtgcacaggacagcccccacaacagataattatctgctacaaatatcaataaagccgaggctgagaaaacctgtcctatccattcctgcccctggctcttttttccatgcctcatcccagaaggcctttccttcagtgccgcccgatgaaatgttctctatccttaaaatgccagctcaaatgccacatcttctaggaaacacatcccgcatgaacctactcccagtgccgtgggctctcaaagtccattctgtgcatcactgaagtgactaccacttagttcatttacagtaatttgtctctagtactattattttttaatggttcttattgttcttttcttgttttttaattgaatgtttgtgtgttgactctttgggtgaactgtgtgttccttgatgacaagtatctctcttgtctatgtcctacagcacttaccatgtgttttacacatagtaggtgcataataaatatctgttgactgcatgagaaatgtatgtcttcctgtgcctttagatatggttaccccttccaacaattttcttaaaggagttagttcaaaaaatccaacaagttgaatccaagtttttttgtttctgtttttaataatttaggtaaaaaactgtgacaagaaatcattgtacaatgcaattatttatgtttatttctgcagctatttagtgaaaaaataagtggtgctgaaggaactaaactagacgatgaatttcttgacatggaaagggtaagagcattttaatatgtaaattgattagaaactgactttcattgtgatatgagatatactgctattgtaaaggatattcgagtggaaatctaggatgtttaaatataggtgtggattatgcaatctacaaggcagtactttcccacgtcccagcccaaatcagatcctccccctgtagccacatgcagtttgggcaggtcgagtaatgagatcgatgtggctaactggtaccctctagtggccagaagtcagaatgtgcaaaagatgggcaatcttggcagttactgcaaggccaaagtaattggtagtatatgttttggagaatcaaaatgtatttctgggacaagattttttgaaatgcagaatgatttatttaccgtgtggaagacttgggctctgctcccatgtgttgcaggagctgcatagcaagtaacttttatcctggttctgcctgtagaaccagagtgtgaacttggataagtgaattcatctttttgaactgatacagagatgacaagtgtgccctgcttgtctcacatggattttgtgagaattatgcaaacattaacgtatttgaaataacttacaaaaaatatgacgggcttgagacagaaatgattgtaacatgctccaaagaaaaatggtatcatctctgtcccttaacatgtttcccagtcagctgtgtggagttgctcaggtggaggcagaactagaaccaccagtattaacaacatactgtttctttgctcattgtctgggccctttaaacatagccttgttttaataattagaccccccaccccagaggagagagggaggaaatgaagcaaggcatccaccctcaggtgtaacatcaaggctgcagatacagtaggtagcagagatgtcagcaggtgctggggaaggaagtccagccccaggctgcgcactgcctgggagagtatctccccaggataccttggctctggccagctcatcttccagggagttctctgttttctggatgagaactattaaatgtctagaaatgttaatgccttgagggagaaaagcttattttgtttttgcttttgaaagaaaacttaatttctgaaccttaaaaccatggaaacatgttcacaccattgacataccttaaattacttaaaaaaaactcttaatatacaaataggtgatgtatagctttgttactaacaaaatgattcagttgaaatgttaaatttaaaagcatttttccagagttttagttttggttgatggattgagatccttcttgcttacctccttttacctccaaaaaccccagtgagttacagaagaaatataaagtctattatctgttttattacagcagtgaaaagcatggaaacatataatacatgaccagaagttttaaaactttccagaagagatgcattagatggtattagacccacctaataaatgatacagaaatgagaaagtaatgggaaaaaatattctataattaatgctaaccatataaaaatagaggaacaatagtaaaatcaaaataaaatttgatgcaagagaagcactaaattaaaaaagctttttaattataaaaagatacagtcaatgtagtctatcaggaaattataatagttatgaaccattctgcactacataacatagcatctgaatttttaaggtagaaactgtcagaaatacatagacagttgataaaaatagaagtagacttcacatacctctctcataaaataatagattaaactgacaataatcaataggctcatggaggatttgcataaaatatgattaataactttgattataaataaatatagatatctgcattccccaaatggagaatgtgcatatttttcaaattcctttggaacaaatatggttatcaattatgtactaggttatagaaaaaaaaactcgataaatttcccaaagtgattccatagaacataagaattataagggaaagtagagcttctaaattctggatgtttggaaatttaaaaatatgtaaaaataattcttagtttaaagaggaaatggaaagtaaaatgacattatttaggcatgagtgacaattctgtatgtcaaaacctgtgatatgtggctaaactgtaaatgtatttaaagaaaataaatgttgggagaaaatgaataaatcatgcaatccaagaagctaggaaaataacagcaaattaaatcactctaggtagaaggtagaaatcaatatggataaaaaaagagattaataaaatagaaaacaataaccacaaaagatcgaaacaatgaagccaagagctttagaaaagctgtaagacaacaaacctctaccaagtgaggccaagagggagaaaaaggaaaaacacaaacaaattacataaagaagaagaaagaggatatgcccactgatagcattttttaaagagaatgctgtaaataagtgtcagaaatgagagctgctagcagctctctcactcagggactgggcctaagggagtcagtggcacaggccttgggacacctcatgggcagggtgccagcattaaacagaaattccagacttaactaaccaagatgctgtcataccaggttgacttcacaaaaaataatttttaccattctgcttccctctatttttcttaatggtttggcaggatatttgcatagcatttggttgacttgaacagacacacacacacaacacacacacacacacacacacacacacacacacacacacacacacacacactatagtgtccctagttattctaggagggagattttgtttttaagctacatgagtttttgttgttgtttttttgttttgttttgaatgctcatcttgactccacattagccaatatgtttactcttcaatttgtaaagggtttatttctagttttgatgcttgggctggtgtggaggcagctccagtatgtgcatgtcagggcctacaaggtacctgcaagtttttggtcatttgtttcttgggcttttttgtttcaaaagatataaaaaagatctgaagtagaaaatatccccattctaattcctctcatcatcatctttcagagatgactcttagctttgtggtggcttttcatgtccaaaaagggttgtatatatcaaagggagcactctaagttatattttaattaatatctaatttgttacattataaatctaaaatcctcatttttcttaagctttaaactgaacttatgaatcttgtttccaaatttagtaattttgctatatgatgaaaatcattatagttaattttcatttgaggttgcattaattaacacataagcttaacagattcaatccttaaatatttaccaccagttatataattaagcaaattcccttagacatttcaagctataatcacaaaggcaaggtacaggactccctcaaactttacataaaatctattaacagcattttcctaagcccttacatttcttgtgactaataagacatatttagttaatcagattctcttaaacatttcaacaatcttggcaaatagctgaacataccaaagagagctcaaagtcacaaaacttgttactaggccaaacgcacactcacatgcccacttgcacacacagcacacaagtatcagtaatataggtttgactccttttttatcatttctgtactgtcttttaaaactttcctggggctccagattaatttatttagcccaaattaatgtatttacctaaggggaacaaatacgatttcaggctggataagattgcttggttgcaaacttgtgaccctggcaggatcatagttttctaaattacaaaaatgatttgtcttctattataaatcattctgcagcttgcttgctttctatgtatgtactttgaatgtcgatcttccttattttttttccttatgattaaagagtattcctttacttggatgtttcataatttatccatcagtctcctgttgatttccattttcaatattacataaaatggcctaacaaacatgtttttccttcactgcaatttgctcgtgtgtttctaaaaggacaaatccttagaagtataatagctggtttattaatatgcccattaataagcacttctcccttgatctccaaaaacgtatcattttgcattcctgttgtgtgttactccacacccatataatacctgatattgagtataactgattttaaaaatgtttttatcaatctggagaatgtaaagcatctcctttttatttacagttctgaatatttttttcaaatctttgtaggcagcttgtgtttttcctcttttccttctttctttttaagacatggagtctcgctctgttgcccaggctggagtgtagtggcgtgatctcggctcactgcaacctccaccttccaggttcaagcgattctcccacctcagcctccaaaatagctgggattataggcacccgtcatcatgcccggctaatttttgcatttttgtagagataggatttcaccatattggccagcctggtcttgaactgctgacctcaggtgatccacctgcctcagcctcccagagtgctgggattacaggtgtgtcccaccgtgcccagccttttccttctttcttgtttgtttaaatgggagtttagaatattatgccacttttgtcaaacttcacatactctatgtcttttcatgttcagtttttaagtttttacggagtcagaattttggtctttttatttatgacatttgaatttcaggtcctggttagaagtttcttcccactccagtatttcaaaatactgttgtctgtatgttagtcgttttatagtctgatttttttaggttgatatttttaatcatgtatatagtatgaagactcactttactatcagcttgccaaattttaacaaaaaaaagaaaaaattgaaattatgatgggatttgaatgaattttgcatgttaatttgggaagaatgcatatctttacaaaattgagttttcccatctaagaatgtggtttttcaaataggtgttgtgaatttctcataatagttattcttcattattgcatttttattgcttttatgaatgagatctttttcttttgggctactgatggtataaataaagctattgcaacttgcattttaactttattgtttattcccatattaactctctggttaactaacaaccagaaagtccaggaatggttttgcagaaggaaagattcagtcttaaccagaaagggttaactttcagggaacgtttggggaaaactttgatgttaacatcttctgaccatagcacaaatgaatgtgtttattgtattataatataatactaatgattatgattcttttagtgttgattactgaggcagttgctaatatgaatcattactgtggcatccttatataagtatagaaattcaagttcacctagcagataaggagagtttggttcatatctagtgttagttttgagagacttccaagtatatctaataatctagtggagcataataacttttccagattttctaaatattaccttaatattcattttaatgtttaaagggaaagtaaagttctccaacatcacttgaaggaaatgatgttccaaaaatcagaaagtgagaaaatatcacctctcccaaaaatgttgaaaacgttcatttggattaaaatcatcataatcgtgttagaagaattaaattaatgaaaattcctcctctatttgctcttttgtgattttattgagtttgtcatttactaactttttttaaattttgcttttaagaaaatagatgttaccaataaagttgttgcagaaattctttcaaaaaccactgaatatcttcagccaaatccaggtaaagttgaaatattctcttgttcatttgctgtcacagactctaataacccatgtttacttggtgtttagttgacataatgtagaaacaatgtcgtctgtgtcccaataatgaaattcagtttttaaagctgagtctccagtgaccaaaggtagttgcattcggtcctactgatgagaaagagaacagctatttttgtgaatttcagttgacatcatccgaatggagtgctggtcatagcaacaagagagcactgagcaaaggttttatgagttgcttcagaaagccactaaacatttggcaaatattttcttccttatttcctctttataatttttttaaaaattctgcccttgtgtactatatacataaaggtatatgttaatttgaaaaagctttctctttgtggcttaaatgctggagaaacaagatgtggtgaatacgaaaggctgcttaaatccagtgtcacatcagcttctccactgaaggtctgggtttctaggtccccaagcagcatctattgatgagattttcccaggttgtaaattataggaaccaatagagggcgcccaagctttgagttctgtggatttctaaagccacctttcctttttaggaatttattatctgcgtagagttcctgtgattcccttgactgtaggaatcagcacaaacctaaccatttgaaaattgagaaagtaaaaatttaagaatataaattttatcaggtgtatccaggcaggtctaaagttctttacaattgtattgatgataatagctttgaaaaccataaaaatatatcttctcctccctggccacatcagtgattgaaatcagccacacaaatttcttttcctgatatatcagtcaacaaatatttaatatgtgctttctctgcactagaggatttcggggtgctggagtacactatgaaatcagacagatacttcaccctcaaccagctgactcttgaatgggataaggaagtgttggccaacaataaaagtgtcaccactggctagaggtctctggttattcctagagaagaggcagccctagcaacctcttatccagtttaatggctctcacccacatacctgctgcatcccacatccccctccaacagtgggaaagatgggcagagagagagagagagagagtgtgtgtgtgtgtgtgtgtgtgtgtgtgtgtgtgtgtgtgtagtgtgtgagagtgaagcctttgggcttggggacctggaggataaatgctttgaggataaatgtgaggttcaaaagtccggcactggccaggcacaatggcttatgcctgtaatcccagcactttgggaggccaaggcatgatgattgcttgaagccaagagttcaagaccagcctgggcaatgtagcaagactctatgtctacaaaacattttcaaaattagccaggtgtggtaacacgtctgtagtcctatttttactcaggaggctgaggtgggaggatcgcttgaacccatgagtttgtggccacagtgagccatgatcataccactgcactacagcctgggcaacagttgttgtttcaaaacaacaacaaaaaaggctggcactgtgaatgtcaggtgaatgtgagtggcactcacagctggcacgggaatgtcactactcacagtgcattctattgctggagatgcagaattaggctcaacccagaccgatggaatcactctacattttaacaagatccttgggttatttacatacacattaaagttttggaggcattgatttaaaatacattaaaaatagtacaaaattattaaagtaggaaaaaaagtgtatctcttgactatctaaaagtatctcaaataccacaaactagtatgtgattcactctctcacctacaggatgaaatctcaaatccttagcttggtgttcaattcatagtcacattttcccatagctatctcccactttgtcctgtattaatagcattttaggtcaaaccagcctactccttgtccactgattatgccacagtattccctcttctacacgttactgacaccattctctgtactttttagggcatctttccatctttcttcagcatattgccgcctttcccttgccctgcaccacactggactttattttcataattatgtcctgtatattctgcctcccagtaactagactttgagctccttgagggcaaagcctgtctctggagtcccagtaatgagcacagtgtgttgttgcacagggcccagtgcaacaatgagtaaatactcattgcctgagtcagaggaaggaaaggaaggtaagacgcagtgatgcgcatcacctccctagggagcagaggctgagctgcaccttgggaccagccacacaaggctagtgttcactaggggtggggtggtctgtcccctcctatgattctgcctcctaaacagcagcacctgcctgccataatactgaaaatcattaggctcaatcagtccttgggagcagagtgtgtgtgtgtgtgcgtgcgcgcgcatgtggtgtgtgttaatgaccagttggttgtttgaaatatcctcctcggcaattctatttttgtttacatttaaacaaacaaacaaaaagcatgtcagtgtcacacaggtgtcagtgtctgacttcacgtgtcagcaactgcaagctttccaaagggtctcactcgaggggtggtgctcaggaaagcctggtcactattatttcaagtcagcaatgtgccccatcatttctttttttttttctttctttctttctttcttttttttttttttgagacaaagtctcgctcttgtcccccaggctagagtgcaatggcgcgatcttggctcactgcaacctccgcctcccgggttcaagcaattctcctgcctcagcctcccgagtagctaggattacaggcatgtgccaccacgcccagctaattttttgtatttttagtagagacagggtttctccatgttggtcaggctggtcttgaactcctggcctcaggtgatctgccggcctcggcctcccaaagtgttgggattacaggtgtgagccactgcgcccagccgatgtgcaccatcatttctatggttcatcgtggctgcggaacagtgcacttagcacccaccttggtaaagaacctagaaaattacctgagaaaattaaatagttcacacacaattgtttcaggcctcaggtctctggcattttgtttaaggtgacctcagttttggcagctgcgtttattaaattctatgtacctgtcactccaccttgtaactttaaagaattacaaatgacaatgtttttaagcatacagagctaagctaggaatgctgaacactgtgtcgaagatccgagggcaggtgaagaccacaggatacccgcagacggaaggcttgctgggggactgtatgctgaaatacgggaaggagctcggggaagactccacctttggtgagttattcagagatcagctgggggagctgagaactcctccagtatggttttaggttatacacaaacccttcagtctaacaacctttgttatttttccatattaccaaagtaatacatgttaattgcaggaggtttagaaaacataggtaagtaaaataaagaaaaatgctaacatcacccataatcccatatccaccgataggcccaattaaactctgttgtgtatcttttttttttttttttttttagacaaagtctatgcccaggctggagtgcagtggcgcgatcttggctcactgcagcctccacctcccaggttcaaacgattctcgtgccttagcctcccgagtagctggattacaggctcaagccaccatgcctgactaatgttttgtattttaaatagagacagggtttcgccattttggccaggctggttttgaactcctgacctcaagtgatccgcctgcctcggcctcccaaactgctgggattacaggagtgagccactgcacttggcttgttgtgtatcttttatgccttgtttattcttatatgtattcatatgtacttttaaaaactacagtaaggctatagtacatatactctttggtaacactgactatataatgatccatatcgtaaaataattaatcttccatgatattgtttttaatggctacataatattccatgtatcatagtttgttcagtcaatcccatttactaaataaatgtttctttatgtaaaaacattttacatagcatttacaataaccattttcataggtaaatctttggggatatccaaaattatattctttgacataatttagataacatgtctagtataaaattgctgagtcaagagtatgcttatttttcaggttttgaaagcatattcccaacctacccttcagaagggttacactcatttgacactgttgccaggagtgagtgagggtatatttctctacatagttcctaaccctagagattatctttttagtttacttttaaataactgatcatttgatatgtagtatacaaaaatgatatctcattgctgttttaactccatcttttggatcacgtgtgaggtggaatttttatttgtgtttgtcattgtttttgtgaattgtgtgtttgtgtccttagcctgcttttgcatcaggaggtccattttttcccccctgtctcatgagctctttaaatggtcaggatatttgctcattggctgtcttgtatgttgatgaagctttgtcccaggtaagcatttgccttcagaccttgtatatgaaggtcatttcaatggagagagatttttattttttatttactgaagctctttagtcttcctatatggtttctagctttttggaatcatgtttagaaaatctttttcatcccactccctggcaaatgatataaacgtttatttatacttgtttttgaatcctgtattttcttttattgcctttaaatttccaagctcctgcatttattggagctacagtgcaatagggttctaattttgttttctaacaaataaatagcttgtttcagtactgttgaaaagtccaactttctcctgatgatttgaaatgattcttttattataggctaaattattatacattaaatttgtttatggtctttctcttccgtttcttgatctgtatcctgttttgattcagtgtcatattgttttaagtattgaagttttaaaacatactttaatatattatttactaaaaatttaggtattgtattgcaaaaagttcacagacacacttactggttttatttttccaggtgaaacttaagtcccttttatttaaaaaagtcattaaattttgattgagattcatttaaattaatacattaaattgaggatgaattggatttaatatattaagtattcccaaagaatttggcatatttgctattcatatagtggtaacaaggcaggagatggaagagatggaagttgagaaatcaaatatttggccacagtaatcattctaggaaattggaggaaatatcttttgaaaaaaatgttaaaactcaagcattaaaacacgaattaattagtgacaaagggtaatattatccctcagagcagtataatgtgaattttattttattctaagggccaatggggacaagatggcctatttcttactctgaaggcacatcagtgaagggagcaggtgaaactgccaggcaggccttgaaatccaaggacactcctgccgtgcatctggccttggcgacagccagacaatttggtagcttcccaggtgctcggcaaccgaaaaaaacttgggatgaggaagagagctgatgtcagcagggcatcaggaacagatggatttctgctcttccaaggaagaggctgtgccgttggatgttttcttttggggggccacatactgggacctcctacagtacagaaacctcagtgggtggaggctgagccccacacccgtggaattcgacagcgccagtctcaggcaaggagagggaatgttgattccagggaggtggcggcccatgttcagagcatcatctttggagtctacagtgtatttgaaaatgtttctgtcaaggcgaaatgagctgacattgtgagacactggcactggtggcagaggggctgtgtagggggtcaggcaataccatttctcaccatttgggcaggaaagagtccacaggctaggaagggacatttcgtcttcatttaggaattatttagacacactttggagagttgagctaaggaaatgtagcttccaaggaggaatgaagctaccactgggtccgtatggagtcctgggaagccttagtttagagtaacggttcctacttctgttttgcaaggtcctctttagtatctttctgttttttttttaagggaggtgaggcacatgttgccatctctattttacaggtaattaagttgtccatgccctcacctggtgggtgaaacaactcaaaggtcagacttaggctgggctttacggtcttcttcaagcctagaaatggagcaacccaatctccatctttttacaagatcaatttggaaaaacccaaatataggaaaaatagttcattctagtgcagcatttcccagggatgttttctagagaccctgcaaccctcattgtacagagaactagagggcacctggtttgcagtaatctggcaaattactgccgattaaccggactgagatagcacactgtaatccaggaaaaactacctgccactacccgagccaggaaggctggcctgggctccaacgcaccagcagacccccaccccaccctgctgacaggatgtcccatgtgacactggcaggctttctttgacatcagagagggcagggaggcttagaaccttctagaaggatacggggagtagccttgagaagatcccacggctagaagctgagatgttttgttggtttatttctattgtaatttttactggttaacacttagccccatgagtgaatcctttcattgtttacaaagagattttattctcaagcttctaaggaaccctccgtgccagtttcccaaattaccagttttttagaaaggatctttatccccatctagtggtccaaatggtaagtacttcggtctgctagcctcagttgtattttctgtagtggtgaaagtgcagaccatagagaggaaaatacagaaaataggaagccttgctttttctttttcattctgatccaggattcagaggtcccggagcaaggaccttgctacaccatcatccacacacttttggtaaagaatgaaataaatagcactgttaacctggagtagtgttcccaaagaaccttttgtatttatgttttctattcaaggcaatgcattgatagaagttggtgaatccatgaagctaatggctgaggtgaaagactctcttgatattaatgtaaagcaaacttttattgatccacttcagttactacaagataaagatttaaaagagatcggggtaagtcttccagggtataaatatacctgttgctacataagatgatgtttatatttaaaatcactagaacgtttcagcagactgaaagcatcatcttatgatgcttgtgggtagggtaaaaatgactcagttctattttcctgggctcactgggaaagagtgccaggatccattagtcctatctgccctggagatgaagcaggataatgggagggaatgtaagccatgttctttcagctggaaattctgtatttagttgaagccagctctaagccaggctaaacaaagtaattacataactttatagtggatttcttattatcaaaatcgtaccatagttgcatgttttgatgcgttgccctggtggtcattattttccattacttctcaagaagatcaatacctagaaattgaatttttcatttggaaaactgttaaaaatggcgtgcatgggaattttcaggtacctggagataattgcatgccacttgcatggtggcatttttgtagatgtgcaaaaacagccccaagacttctaccccaccagtgacttccactctggaggtacaagcaccgtcttatggatatgtacagaagatgttcctccaggtgccttcagcatgatctcagcttggaggtcatttgagccttgggcatatcctgttttcccttcttcagacctattgattctcaaagtgtggtccctggaccagcaacatcagcatcacttgtgagaaatgcaaattcttgggccccatcccttatctcctgaatcagaaatcttatgggtgaagcccagcaagtctgtgttttataaagtcctccaggtgattctgatgcacgctaatgttcagaaaccactgttccagcccatcctttccagaactcgagggggaagtgtgaacccccactggtctagcctatgtgacagagatgaggctggtgggatgtgtgagcttgggtggccttccctgcttggaccgtgggccttgaggtggctccatattccaggggccagagaaggaactgatggatgtcagattattggttcttcctttgttcatttatttattcatccatcaactgtgtatagcctgctctgccctgctacagtggtggtgggcactggccatatgtggctaaacaagacctggtgcatgcccttgtgaagctcacaggtgtagggtagagagacaagtaaacagataccatgcactttgacagttgttggagagatgagcccagggacatgaaggagaagcacctctttcagcctggatgggtcagggaaggcttctcagaggaggagaagctggctaatgcagactgggagactggggtgggcaaaatatccagcacaagctgaccagagggccagggctgtgagagcaggcaggctcggggacctcggttgtgtgatatggccaggggatagggtgtgtaggggtgggggtgcaatgaagggaggaaaggctgagagtcacggaaagccctggatgcctgtccaggcaatgtatttagaatttctgctgaaagcaaagggtatgagggagaattcaggaagtttgagtgagaaatgaaagcatccattcaggagctccctaaacatcccattccccacctgcacaccccttggccccgacactcataccatcctcttcttccatctcaggggaaacatgtccctgttgctctcaagccagtcctcctctgggccgcagggtctgtcacctctcacctcctcagggccgttgtgacatccatcgtcctctctggtgtatcttcattctttccctttctgtctgttggcttcttcctgttaacatttacacacagcacagctgcccttgacccctggtgtcacatctcactccctcctgtccattctccagcccacagccagggcaccctttctgagctgcaaaccttcctggctgcccactgacagtggggtgaagatatagaccctcagcccttcacagcctggcccctcctttcctctgtggccttattgccaccccttccccacatgaactctgcccagcctcactgaattatttccagctccctggtgacgttttgctttgtgctttctcgctatttgctgtctttgtcctttcaccccttctcctggctgtcacctcacccctcagctcggatgtgctttcctttgggaagctgtttgttctttcgctagacttcgtggggtatcccttctgtgcctctgtgtcatgagcaccgttgcttaccttttgctcatgttgggcagtccattcctcggggtgagtgatcgtggtttgttccttgtagtcacaagcctcccacgtggtttgtgctcacacattattttatttttttaattttaatttttgtgggtacgtagtaggtgtatatgttggtggggtacaggagatgtttttgcaaattatttttgaatggttgattctagagaagtgacagtctgggttctggggatgccaaaacatctcccccaaatgcacagttgtaaaaccaaatgcctcctttgctgacatatagcaagttttatttcttcttgtgctgtcatcatggaggaaggtcatatgaaaagtcagcattgctcctccacctggccaaccacagacacatatgtggtcctgagtagtaagtgggtgaaatgtgtaaaacacacttattctgaaatgttgcagttctctatgcaacaaaatagttttctaaatgccatcttgttactcagctgctgtttgatacagaactgtaaatctaaacttaaattatgtggatgatggaaagttaagagtccaaggtttaggaagcctttcatagtctcagctatgctctgtgtcgctcagaaatcaggggtcaggggcctgttcatttgacatacggctgactttcaggtgttcatgtagaggtacagagggattagggaccagcccaaagtcacagagcaaagagagagatgtttctgactctctgggtcttgtgtgctcttttcactgagtcatggaagttagaagcagtgcttcctgctaaaatgaatagtgcgagctatccccatgcttcagtgggatgatcagtttctacatacactttcgatgcctggtatctgatttccgaggattatagccataaactctccagggacccctcccttgtcctgtatagctatcccactcagcactgtttctgacacggggtctctctgcttggacacaaactgtgatgggaaacctactgctacgcaaggcagcctgttccatgagtggacagttctaactgttatattttgttaaagcggttataatattgtttagaaattttactgtttcagaggttgtctgtgaatctctctcctttgcattcattaacagcgttttacgcaacttatttcttgattgtttgggaactttacggagatccgttaatattctaagggattgtagaagtttgtgattttatagtctactacttagtcaggagttgacaatagtaccaaaagaaatgttcctactgtgttttgtttggttaacctggttagaaattatctggacattaagaaggctgaagtgagggatcgtataaagaacgttggaaaataatatctgagcatggctactgcatcattacattccataaagacactcattcattctatcaccgatctgtccattcattcattcattccacaaatattcctggagcacctgaagtgaggggagcctccatcaggtgctgaggtgctcccaacagcagtgtaaggtgggttcctgccctctggaatctaggccgagaaaaagcaatgaccattttaatagaaataattttttgtgccaggttttgaatgtagcacctctctgagggactccattctctttttttagcatcacctgaaaaagctggaaggccgccgcctggattacgattataaaaagaaacgagtaggtaagataccagacgaagaagtcagacaagcggtagaaaaatttgaagagtcaaaggagttggctgaaagaagcatgtttaactttttagaaaatgatgtaagtatttaaaccaaataggagattttaatgtaaatgaatgaaacattgaatatatgactatgatcggcatgttgaaaaactctaaagcaggagtgtccaatcttttggcttccctgggccacacataaaatacactaatactaataatagctgatgagcttaaaaaaaaaatcataattttttttttttttgagacgctgtctcgctctgtcaccaggctggagtgcagtgtctcggctcactacaacctccgtctccttggttcaagtgattctcatgcctcagccttctgagtagctaggattacagccacgcaccaccacactcggctaatttttgtatttttagtagagatagggtttcaccatgttggccaggagggtctcgatctcctgatctcatgatctgcctgcctgggcctctcaaagtgctgggattaaaggtgtgagccaccacccccgtccaatctcataatgttttaagaaagtttatgagtttgtgttgggccacattcagagccatcctgggccacatgtggcttgtgggccacaggttggacaaacttgctctaaagccttagttgttatgcaagtttctagaattttctcctatctcctgcctgagagattgattgcttcagacatccagcaagccctgactcacatctttttttggagacagggtctcactctgttgcccaggctggagtgcagtggcacgattgtgactcactgcagcctcgacctcccaggctcaagcgatcttcccacctcagcctcctggatagctgggatcacaggcatgccaccaaaccctgataattttttgtcaagatgggagtttcgccatgttgcccaggctgatcatgaacccttgggctcaagccacctacccgactcagcctcccaaagtgctgggattacaggtgtgagccaccacgccagcccctgactcaatatcttaaatcttgaggagtcctgtttatcccaggattgcttcagaggttgtctctgaagattgctaagtagactggcttttgtatgtgaggccataggatttatggtttcacaggagaatgaaaagtcgaggtcatgtagtaatttgccattttgctgagactgaaaagtacttggcaaggcagatggttaagggagaacagctctcttatctggggggcggacagccgctgtcatcccccagctctctggtgcctttacctgtcatagcccacattgaggacacaaaagcatgacccaaatttttcagctgttccatagtggtgcttgtgggctcgggaattgtgaaggtctcggatcttatccctcagaagtgccaatcttctattgtactgtggttcctgccatttgctttgatttgatttgtccaagtaaagtcaaatgaaatggaattaaggaggacggtgactcctgaccaggcaacacgcagctgggggtggcctccctgctcggccttgggtttaaggggccattggcactttgactgcctgagtggaagaggtgtcagccacctgcctccctccggagcccctgccctcagcctggcttcagcgatgccaggagctgtctcagccccagcattagtatgggacctaattgttaagtttttaaacctgtgggaacaagtcaggaggtttatttatcctcaagaccatgtcgtccttataacagtttatttaaaggtacactgaggtcttacatcctttgagtcaagtcaaaatgcattgagcaccctttatttaccatggtgatgtatggaggaattatgtccaatactaacaagacattcatcctggagaatttattctcccaactggaaatgccaatttgaaatttcccatgcccattaaaccactgaggcctgaaaagtacactctactgtgtttcttcttttaatttttttttttttttacattttttttgggaaataggaggaggtgtgacagtttggtatctctgtttttctttaaatgtataaatttcctcttgaaattgtccccaagcaacagcgattttgttttgtttcagattgccgtattgttttgaagtctttagaaaatgtatttgaagtgtgacatgtatcagatactccttgttgggccatatggaatgttgccctgctggctccaggcccattcatggcttaaactctgagattgtgtcttgtgtgtcagatgcgccgtctgacccatttgttccattcactgccttcatgcgggaaccacaatgatgggtttttgcgaagtgctccatgagggaagcctgtctgagccacgccggccttagcagttgacccaagagacctcagttttccccctcagtatcagtcaaaagtcaaaaaggatcccttcattataaaagctcaatcatttgtccatgttttgacagtaacacgtattctgcctgtcacaaatgggttaagtcctcccaccctgccccagcagaagtaagagctggttcctagcccaagctccgcaggggctctggtgctggccttgctccggcctggttgcagtgtttcctccaaggcttcctgtgggaaattgacctgcaggtgagtggaggtttcccctgttcagctctggggagtcagggctgctccctcagcctggatcctggggtcttcaccttcacaaggaggggttgtctggcttctacttctgccattgaggtgggaggagaccaacgttatgaaacggagatgggccgcccaggctgcccgggaactaggctcttccctccttcctgcttcctgcttcctgccatctgtagctgcaatggctgctaggtgtgctctggctgctgcttcttgcggtaatggtggtgatcgtgataatgataaagacagtggtgataatgatgatgacaatgacaagagctaccattcactgacaccccatgataaagaggctaagggggtgctgttgatggtccctgtcatggtgcatgtgcgtttaccttttctcctacccaggtttatagctgaggagactcagagatgattgtttaggcttcagaagcccatcttactctcttcttggggtcaacagcagttagatcagagggaatcacctgatccttttccatgtcagtgtgtctgtgccatagccaggtggtctgaccatcctctcctgttgaccagacaagctagagaaaaatctcctgctggtcactccttggacctgacatgccaatgccgatactgcctggtgcttggggataaacagagaatgtgactagttgggagaaagacaaaatgccaatacatggttgatggggcatacattgaacccttggccctgtgtttggcccatctccaacaaccaggccagagctggtggccttgtagcccatgggactctggtttcctgctccctgtgagtcacaacccgcacgtccaaccttggtcactcaacctcttgttgccatgttgcttcctttcctggtggggaagtcctgcatgaggagctgtgcttcgggatggctggggagggctggatttcctggcagaaactaaagatggctgggacctgttctaatcgccatgtcaaacacagtgggtctttgggtgctgctgcctgatggattggacggtgtttctacctgatctggtacctgctggagacaaggtgcacaaactgtcaaatgagtggctgcaagggaagcctggtggcaggcagcagaggccctgacacttcctccagacacaagtgggacatgcttctgttactgtggtgggaagtttggggatgtcagtcacagccattcaccctttgggttctgaccaatggaggaagtgacaaaaaagccggattggaatcaagggacatctctttaactgatgagaatgcttgaaaattgtaaaatacagacctcctggtcaactgtgctgaaggacatggcctgggcctaaagtcctgttggcactttcccctccttgcaccttcggtggatgacagccagctctaggggagagcccgcctgtcttaccacccagatacagcctgagacgctgaagctgggtgagtgggagccttgctggccccaaccctgcagagccagtgactgaggcagagcaacccatcctactaactagggagcacccccaacctcatccacaagaggaggaagaggagggcctggcgagaggacttagaagcattcgctccaaagagaaagtgaataagcagagaagcaaatgaagggaaatcctctgagatgggtgtgcttggtgctcttgtgctacctgtccatctctgtttggcactgacaattcaaagaccaaaatctcaccctgggggaagagctggtgccttctccagccctcatgtctcatcatcctggctaagacgcaataaaagcttcaccggggaatgcctcaaaagaaactgtttgccaaaactctgactgatgtgaggagaaccctgactggagttaacagacttggtctttcctgggtctccagatgtagtacttcctagggttttctggccaacaggccatttgcagggatttccagggtgtggttgttcactgtcctcacctctgcattctcccaactgagaaacaaacccagggagccacatgagatcacatgccagccccttgctcagagagcagggctctctagaaagccatgttggaaggggcagcttgggcctgggcccacagtagaagtccagtgagctattcctggcctgaagtctagaccttggagcccctgcagagagagcgggtgcagagaccacaaagccagatgacacacgatcttgtggccacttcacaaacccactttcttgagaaatccggagcccagagccaggcccctactgcctttccttgcagtgtctaggtaccctggttattagggccaagtgggtgccactcccgtaatctcaccagttagatgaatcaccaaaggaaggggaggtagagagacatgacatgctaactctaacattcctaagcagaagttttatctattttctcatctatttttggcagaactgggaatgggagaatgaagaagagtctccttcggccccacactgtagcctttggttgtcttgtgaatgggagctggattagagacattgagcatctcttcacatcttgcctgaggctgagcagtgtcgttattctataggcagtgatgcaagccaggaggtgttttggttctccaactttccagggatccaagaggggcagtcccatgactgatttctcaccaggccaagttgggcttggcagggtcctgagaagtaaccagggcagccctcctcttggaggaaagtgtgggaaagtcagcagactggttaccagccttcattgccgtatcttgggaacactatatcacccataggcttgttaacacactgtcacctcttctgtctttgcagagaagtttattcctcattattcctcacaacttactagtagcaaatgtaggtctttgacattagcagaaatcagagatattccatagaagatgcctatttcagtccagtgagtccaggcacctgcagtactggctgtcttggtatacattcaccagctacgggatcctccttccattcatgggttcccaagaccagtggaattactagattccagattcctgaggtctttccattggtctagagtagcattttccaaaatccattccatgggatgttagtgtgttttgcattaataatgtctctgtggtcacataagtttgggaaaccctgggttaaataaaactaaacagtttctttatcacaagacttttcagagtctttatttgacagtatgaaagattaatctctaagcggttcctaacagaaaatacagttggcagtttaccaaacttatttgaccgcagaattccgtcacattattatattattactaatgtttcaggactgtaatgtgtggaataagatgcattaggaagtattgaacttgtagaaagcatacccagcaaggcgtgagatacctgaattctgtttctgattttgtttctgctaagcctctgggaaaatcatttcacctgactggtatcaggcaaattaacaactgcatttgagaaattctttagaaggataaagtggagaataaaagtgtaagggattattatccatgttattaatttaattgccttactcaaactttctcagaaactctgaataaaggcttttgccccattggaaaagtcatctgtttatgaccagactgcaaaatacatgagaaattttccacagcttctctgaggaatccaaaaagagtagaggtctttgatatgatagagcaagaaattactggtattattacactgtaaattgaaggtgacctctatgggaaatgtgccttttcagttgtgaaagagaatggcttgtcgtcttttgaagatgtacacttctttattcctgcatgccaaacacacttgcagaccccaggcgtctggacaggcatcagctactcacatcacagttctctctctgtcctcgccatgggcttcagggtgtgctactctctgcttactcacccggctgctcaccaagtcccctggtaagggattgctaaagggtcagaggaggagggttcccagccctgctccttctaggcaccccagtttccatagtcctcttgcagagttggcctaagacagccttggttacagtatgcagtcctttgagccattcttcctttgggtacagcctaagccttttgcagttggctcacaaggccaggccaatggctcagatcttatgcaagtgtccctggggtttccataactcctagaaacttctagtatccttagtccattgtagttggggacatctattctctgtttccatccccaggactaagatactcccaacggccatatatgctgctaatcatccattggtttccagctatagagaggtttggaatgaaatgcatccacaggtgacacacgtgtgtcacttgtggattgtttattgtgtatagtctgccatgggagataaattgagttaattcctgttttggggttatccctcagaagagagtgaggagccctgggatacagccaaaccaacaatgaagtccccaggcccagccacgatgggcccattaccccctgagcttggttcttatgcgtctccaggcaacaactcccatcaccatgaatgggggtccctgggcagcactaatctcattgttaggtttttgcatagtttgaggatgggctaaagcagctctgtatcagtttcctattggggccataacaaatgaccacaaactgtagcttaaagcaacacacatttattgtcttccagcctagagtcctaaaatcaaggtgtgggtagggccatgtttgttctggaggctcttgaggaagaagctgcttctttgccttttccagcttctacaggccacctgcatttcttggctcattcttcgcttcctccctcttcacagccagcggcacagcatcttcacgtatctcattctgacctctgcttccattgtcatatcttctctgaccttggcactcctgtctcccccttaaaggacctcgtgattacattgagccattcagacgttccaaaataatctcttcatgttaagatccttaactcaatcataaccgcaaagtcccttttgctatgtaaagtaacatatttgcaggtttggggaattaatatttggacatctttgcaggttccatgattctgtctacctcaggccccctctggttttatggttctgtgtgtctcccaagttgcttcttcacagccctcacttcacacatttgtcaaccaccgaggcctgtgcctccttgacctctaacctacatggaagtcagcttgcattatgagtttctcacttcaaacatcagctgagtgtgagcccatctgtaggagctagagtgcttcactttcagaaaagggagtggattctctggaaatccagttccttggcgtatatcacgtgaacattttcatgggtgaggtcacactttgctctcaagatggcaccagcacagtgtcagcccaggtctcaacccggaagtggaattaaacctttcttcccaccccaggtgactttctctgattcaacagatggactgctgaaattccaacaatggaagaaatgttttaccttttggtcaggttttggctcttgctaagcctgagtttgttgctttatcttggttctgcctgtctaggtatttatttctaatcgtggttcaggaagctgaatgtacctgtgttggtccccatggtccccagcacacagctcaatgctcatgacctgggggacagctggaagcttcaattttctgaaatcaagaggaaaataatctatcgtagcacacctggtctttactgtcaacaagagacttacagcctagtagccagcccttcaggacttgtactgagcacctgctaggtgcaagcattgggcagtgctgccattgtttcccaaggtttaagggttttcaggattcatttccttcccaaagtcagccacccaatgagcagttacgaatgcatctctagattacatcaccttgtgttttagccacgacagggaggatagctggtaatccccttgcccccttcctgttccccaaccccaaatatgtttcaagaaatattaatttagctatctttcactatttctttaaaaattataaaatgcaagcattttttaaagtgggtaataagacagggcaaataaattttactaaaggcagagaggcatagcatagattttgccaagcacaccactctagcactgtaaggaagaaaaattgtttctgtaacaaattctactacgatcgtgctaggccatggccctggacttatttaaaagtacgtgtaaaagccaaagagatgaaatttaagaaatccttaggatttagtaggggccaggctgtctttgttttgtttattgggtttttggaaatttaaggctaggcttgttgcttttccagccacagagcatggtaaagtaaatgaaacccgacaggatttcattgttcggatgctgatcacagcttggcacacatggaattcaatgtgtctcttacatgcatattgagcccgtgtttaaaatagtataagtgagtaagaaaaatttaagtacaggcaactaaagaatgatttgcaactacaaatgaaagtagcttggatctttgaaggctaagtccatggttggttaggcagggtgagattgcataaatgaatcagcaggcagactttgccctaaagctgagtagaaaatgaagtatggaaatgatgcataggctttggggaagcctgggaagtgtaggattgattttgatttgtgtctttgtccagctctagagttgattggattcttgctgggggaggcccatcacctcaaccctctggagcttgcctctggggctttcagaaataagcttaattaatctctttcctgtagcagcccctcagacacgtgggggagcaggaaagctctcaggccttccttagattgcttttcctcaaattatacagccccatatcatccaggtttttccttatgagacacagctctaaaaaattcattgtaagttagtcattaatttcatgaatgtcttgatttgtgggaaacagagatgccagtgtctttatagttcattccctttagctctatgtttcagggaaaatatgttgagtggatagcaacaaaacgcatagaggggacagggaaatctttgccccagttcacatgttgctccctggccccctttcttatctgtttcatttacagttcttaactgtttaatgtacttaatgtcttgatttggcttagctagaaagtgcgtgttgagacacttgacaaagtaggcagttcttttgctaaatgttggcttcgtttgtaactggaagagctttatctctctgttttcagatccatgagctttatagcatagaaaatctgctgagaaaaatcatcatctaattggaaaaacaggcattttattgagttaaatcaaattcataatcacaaataaatttgaacatgtttttccagcatttatagctccataccatgacctgtatgattattatacagagctcctacatgaaattaaatgaaatggaccaaggcagacactggtcttccctgcaaagctaggtctttgctgctggtctcctctctctctggacattacacaggctcgggcctccatggaataattttgcacttctgctgcaggtagaacaagtcagccagttggctgtgttcatagaggcagcattagactatcacagacagtccacagagattctgcaggagctgcagagcaagctacagatgcggtaagcacctccacgtttcttacaagccaagggctgcggaggtaacatctattgaaatccatctgtctgtctctccatctctccatctcccccttcccctgcctcattctgttttgaattttctttcactggctttcatggttggatgtgggatgggactgagataataagtactggctttggccagtaggatagaactgggaaaagggacctggcagcttttctcctttttcttttcattaaatcccttttttttgtgacccgtgtttagggcaactaaccaagttgctctcccacctgggacatcaacccctacagaactaccctggcttcattgctgatttgatgagagtttaactccccattcacaaagggatggaaaacatccagagctatggaaaaaagtgagatgctgtatggaaaatatgtaaatatctgtaaaaaaaaaaaaaaaaaaaaaaggtagtgccttcacttcaccagtacgaatttcaggatatgttcataatattgactagtattgaaagagtcaaaatattgacaaatttcaggctgtgttcataatattgacaggtattgaaagagtcaaaaatatcttctgaacaatcaaagaaaggtttctgcattccttgtgaatttaatcatagatgtagtctatacttttctgaaaattagtaatattatatatagtctgcatggcaaccctgtttattaaaatattttaaattaggtttgataacagaaaattgttttacacaggattatggtaatgcataaatttggagggatttttacttaaatcaatgacgtagttacctagggaagacaaagatgtgttcagtccctgaagcatccacttctgcaggcagatagtttacctgttactgacaggagtgtattttcataattctatcataatctataagagtagagtgagggagaaggcagctcccatcactgggtgccgaccgcgtcccaggcacttgctggatgcctcagagacttgatgaagaaaattagtcttttgttttgttttgttttgttttgagatggagtcgtgctctgttgcccaggctggagtgcagtggcgccatcttggctcaccgtaacctctgctcactgcagcctccaccttccagtttcaagagattctcctgcctaagcctcccgagtagctgggattacaggcgcccaccaccatgcctggctaatttttgtatttttcgtagagatggggtttcaccatgttggccaggctgatctcgaactcctgacctcaggtgagcaccttggcctcccaaagtgctgggattacaggcatgagccaccatggctggcccaattagtcttcttcaagatgaatttcactcacaagctcaaatagggagttgaaaaactgcatttgtgatatcacctccatcacttcgggctactcaagagtcagtgtgtaaaaatcgtccctttcatgaccactggctgtaacctaagttcctgtgctcaacaaggcagagaggatgtgtgtttggaaagctttcaacatcagatgtctggctcatcttacgatgtgtgttacagaatatcagctgcatccagtgtccccagacgagaatacaagccaaggcctgtgaaaaggagttctagtgagctcaatggagtttccaccacctctgtagtgaagacgacaggtaagttgaccattctaatatgctaagtgtgcctttagtaaagcacttctagaaacacttatttactgcttgtttctgggtcagtgaatacacacagaccctggatatctttctttggttgtttggtaaattcccttttcccctaaacgtgccccttttttctgttccctggggaagaattctatcacttatataatgtagcatttagaaccttggccatagaaccattatggctacatcatcctttatttttttaactctttgaaaatattttcttaatttatttttaagttgaaattagcatttttgagcaactgctatatgctagatactatcttaagtgctgcatcgttattttttattaaacaagtgatgcaaatgtgtcttttagtaaaataatcaaacagaaaaaaattggtaaaataatcaaacagaaaaaaaaatttaatggtataagtcattctatagtctcttgtgatcacctacaccatcgcagttcgcttcctagatgtagccactgttaaaaaaatttggtataactattatcatatctattgaggtacataaatatacacataaacagcgttttggatttttttctgttttttctttttttcttttttgagacaaagtcttgctctgtcacccaggctgtagtgcaatggcatgaacatggctcggtgcagccttgacctcctgggctcaagcaatcctcctgcctcagccttccatgtagctggaactacaggtgtatgtgaccctgccaggcaaatttttttattttttgtagagacaaggtcttactttgttgcccaggctggcctgcaactcctgggctcaagcaatccttctgcctcggccttctgaagtgctgggattataggcatgagccactgtacccagccttttttctgttttttaaatgcgagattatactaggcatattgtttggcagtttgctttttaaaatgtatcactgtttcttcgagttatttccatatcatgcatatagatctatcccactgttttaacagcttcatagttttctattataccatttccctattggtggacgttaaggttttttccagttatttgctacagtgagtatcctttatcactgtgctggctacattactattaaagcatgaacacctgcttccccacacccatgccagtagacttccatttctgccaagcactcatgagaaaaaaatggtatccagtcttaatttgcattttcatgattattagtgagggtgaactttcttttctatattttaatttgtatttccttatgtctgaattgtctgtttatgtcatttatttgtgttttttgggagtagtttgctttgtcttattgttttataggagctctttccatatgaggatattaataatttttttcctagtttgtcatttatctttaaactttgtttttggagtgccttgtccctttgttgtttttgctgttgtttgctttgtttagttttgctttgagtatacagaagcttttattttgatgtagtcaaatgtgtctgtcttttgcttgtgactttacattttgtgccctgtcatgattacattttgtgccctgttgtgaaaagtcttcctatccctgaagttattcttctacagttttctactactttgaataatcttttcttaatatttagatctttatcataaggatttatttttctaaatgaaaagaaattcccaaactatctttcagagttgtgctaccatttcacatccccaccagcaatatattagtgatctagtttctccacatccctgccagcatttgctgttgtcactgttttttattttagccactttgataggtgtgtaattaatcttactgtgggtttaatttgcatttccttagtgactaatgatgttgaatatcttttcatgtgtttatttgccatctgtgtatcctctttggtgaaatgtttcttcatgtcttttgtccattttctaattggattgtttacatttttactgttgagtcttgagaatgcttgatttattctcaatacaggttctttctatatatgtgatttgcaaatatattctctcgctctgtagcttatcttttaatcctcttaatagggtctttcacagatcaaaatttttaattcttatgaagtccaatgtattcatgtttagttttatagattgtgtgaagtctaggaattctttgcctagccctaaataataaatattttcttttctttttcttttttttgagacagagtctcactctgtagcccaggctggagtagagtggtgcaatctcggctcactgcaacctccgcctcccaggttcaagcaattctcctgcctcagcctcctgagtagctgggactacagacacacaccacaatgcccagctaatttttgtatttttagtagagatggggtttcactgtgttggccaggctggtctcgaactcctgacctcaaatgatctggctgcctcagcctcccaaagtgctgggattacaggtgttgagctaccatacccggcctctcctatgttttttcttaagtccactttgtgttaattttgtataaatgtgagacttaagtcatttattttgcctatggatgtccaattgccctttcaaacacacattgctcatataagctgcacagtgtgaattttcttccaaccttatggctatccttaaaggtttttttttttcatttaaaaacaaaaattatcagagtaatatgtgtatgtagtttaaaaagaaaatggtaatatacgtatgtggttttaaaaaggcaaatgtagttacctctacctctgtgtgaaaacatgggcaggccccatgaattttctcattattaaaactacaaattatcagagtatatgtgtatacatttttttattttttattttatttatttttatttttttgagacaaagtcttgctctgtcacccaggctggagtgcagtggcgccatctcggctcactgcaagctccgcctcctgggttcaggccattctcctgcctcggccccccgagtagctgagactacaggcgcccgataccgtgcctggctaattttttgtatttttaatagggacggggtttcactgcggtgttgatctcctgaccttgtgatccgcccgccttggcctcccaaagtgctgggattacagctgtgagccaccaggccgggccatgtgtatacatttttaaaaaaaacatggtgcaagctttttcgtgagaaatggcagtttccccatcaactcctttcccagtgcttattttctgctctcagaggaaacactttcaactcttttacatatttatttggtacttaacttcatggtgcttgttttttactatttctttttttactctgattcttcagtttggataaatgtattgatttcctgatatggaagataatggcttagcttcctaacccttggtcttccatagacttctccctcccttcacccttccaatttacttataatcactatttttgttaaataaatattcattgtgtaatcatcacttccatcatgtgggactcttaaaatgcactcctccccttttttccctgctcttattttaaattgcctactcacggatgaaaatgtgagcaggctgcatgacttttctgactactcttgggtcacataagttctccagtcacttgaatgtgtaagtgcaggctcgtgcagtagtcaaaatgctaagacccatgtcatggtcaaagctataatcttgatttaaagtttggctttcactcctccccaagctctggcctgttgccgtgggaacattggtgtcagggaagaggttgtatttggctttttctctttccccatctaccccttctgttcttaagtccccagagaatgtattttaagctcgctgaggaatcttttaaaagttcttctctcttgatttggtgtgaaatgaaaagatcacaacacatcctgcctcctccacactctctccaacatttttctaaaaatcctttttaatctccatcttctgacctatttatgccatagatgtaggctgggattaaaagttataaaactggctaccctcatctcttctgtttttgtttgtttccaaatcctgcataagttgtcttctgcacatcggtttaataaaaaagaacaaacaaaaaaaaaacagttctggggcctcatccaaaacttccatttttacatcgcctaacacttatttacaatgtcatgagcacagaaataatattcacagcagtatcacatagtgcactatcattgcatttctattcttgtacaattgttgtcttgatgactgtagctttataagttttgaggtcaggccctgttagtcctctaactttggtcttcattttaaaagttgtttgactattctagttactttgcattttcatgtgagttttagagatcaaattttcaatgtttcaaaaaaatcctgctcagatttttatttggattgggttgaatctataactcaatttaagaggaattgatagcttaacaatattgagtgttccaggcttgaacacaatctattgtatttcccatttatttaggtcttcttgaatttctctcagcagtgtttcactatttttagaatatatacaggtcttttaaattttttcatcaatctctaagtattttatatctttatgcaattgcaaacagcattttaataaaatttccatttctgaatttttgtttctagcattcataatattccattgatttttgtatattgatcttgtatcctgccatgttgctaaatttacatcttaggtctagtagttttttaatagattccatagtttttctacatagatgttcacgtcatctataaatgaagacagttttactcaatatctgcatgcctttgtttttcttgccttttttcacttgctagaacatgctgagtacaaagggttagagtggacatccttgctttgtctctgattttaggggagaagcattcaatacttcataattaaggatgattttagctgtagatttttcatagattttttttttttctttttgagacagggtcttgccctgttgcccaggctggagtgcagtggcgcagtcgcagcttgttgcaacctcaacctgccaggctcaaaagatcctcccacgttagcctcccacatagctgggactataggcacacaccaccaagcctggctaatttttgtatctttcgtagagatgaggattcaccctgttgcctaagctggtcatgaacttctgggctcaagctattcgcctgcttcggccttccaaagtgttgggattacaggcatgagccactaggcctggccttcatagattttaaaaatcagattgagagagttcccttctagtcataaatagtttgaagagagttttaatgagaaacagtctttgaattttgtcagatgcctttttttggtatctgttgagatgatcgtttattttttagttttagtttgttaatatggtgaattacattgttagttaaatcaaccttgcatccctaggataaactctttgtgggaaagtttttttaaattaattttaaattttagaatagttttagacttacagaaaagttgtgacgatagcacagggcattcccatatactcctccactcttctatattaacattttattagtatggcacatttactttatataatgaacatatatttatattagctaaagtccacacttcattcacatttccttagtttttacctgctgttctttttctgttctaggatcctatccagaatagcacgttgcatttagtcctcacatctccttcggcctctcttgctgtggcagcttctaagactttctttgtttttaatgaacttgacagttttggggagtactgtttacatattttgtagaatgtcccccagttgagatttgtctgatgtctttacatggttagactggagttatgagtttctgggaagaagatcacagaggtaaagtgccattctcatcccatcacctaccatctcacatcagtcagaatggctggtattaaaaagtcaaaaaatcatagatggctggcaaggctgcagagtaatgagacagcttatacactgctggtggcaatgtagattagttcagccactgtggaaggaagtttggcaatttctcagacaacttaaagcagaactatcatttgacccagcattcccgttaccgcatatatacccaaaggaatataaatcattctaccataaagacacatacacgtgtatgttcatcgcagcactattcacaatagcaaaggcgtggaatcaaactaaatgcccatcggtggcagactggataaagaaaacgtactacatatattccatgggacagtacacggccataaaaaagaatgagatcatgtcctttgcagcaacatgggtggagctggagaccatgatcctaagtgaactaactcaggaacagaaaaccaaatactgcatgttctcacttgtaagtgggagctaaacattgagtacacatggacacaaagaagggaataatagccagtggggcctgcttgagggtggaggttgggaggagggtgagaattgaaaaactacctaccctgtactatgcttgatcacctgagtgacgaaataatctgcacaccaaatccctgtgatacactgtttactcatataaaaaacctgtgcatgtacccctgaacctaaaagttaaaaaaaaaaaaaaagaatatgccctatcaacaagattaatcactgctgatattgatcttggtctgctggctgaggcagtatttgtcagctctctgtaaagttactccttgtttttttttttttttcctgcatgaaggctttaagctataaattcaacgtctttatagatagaaggcaattgaggttatctgtttcttcctgagtgaactttagaagttggtgtctttcaaggaatttatccctttcatctaagttgtcaaatttattgcataaagttgttcataatattctgttattatccttttaagatatatagaatttgtagtgatttacttctctcaatcattttagaaattggtaatttttgtctttttcttttcttaatcattttagctatagatttatcaattttattgatcttaaagagccagctctctgtctcattgagttttctctgttgtcattgagtcctttcgccttttccgatatatgtgtttagcgctatcaatttccccctaagtaccacttgagcaccatctcatgcattttgatgtgttgagttttccctttcatcctctttaaaattgtttctaattttacttttgataacctctttaactcttggtttcttctgaaatgtgttatatcatttccacatatgtggatatttttcagatctctttctgttttagatacctatttaattccattttttatcaaataagatactttgtatgaatcatacccttttaaattttttgaagcttgcttgatgggccagaatatgatccatcttggtaaatgatctgtgtacacttgaaaagaatgtgtattctattcttattgggtagggtgctttataaatgtcaattaggtcaaattatttaatagagttcttcaagtcttccatattcttgctgattttttggtctatgttttcctattaattttgtggcagagggtattaaaatctctgattatagttatggatttgtctatttctcctggcaattgtatccagaagtatgggaagttggctacattcccttccgtattcctcattcgcattgacccttttagtctgattacttgcattttttaaaacacggaaagtgtgtttttgtttgtttgtttgtttgttttaagatacggggttttgccatgttgctcaggctggtctccaactcctgggctcaacattccttccacctcggcctccaaagtgctaggattataggcgtgagccactgcacccccactgatttatttatttattttttttactatcttaaatatccttctcctctattccctttctttttgcccttgtaaacaactactagaggttgaaactttttgtccttcctcggacaaaaagtcttttcctccttgctctctgtacctctgtttttttattctgccctctgaggacatttcaccttcttactttattctttgatccagttatttatttagcatatctattgaatttcttactccaattgtattagttctctattgatgctgcaatgaaataccacaaactgtgtggtctaaaataacacaatgtatgatctattttatagttctggaggtcagaagtcctcaaatcaaggtgttcacattccacacagggtggaatctgttttcttgcctctcctgccttctagaggctgcctgcagtccttgcctcattgccccttgctccagcttcccagctggtggcatgacatcttcagatctccctgcctccattgtcagatctccttctctgacttggattctcctgcttccgccttataaggacccttgtgattatactgagcctacccacataaacccagggtaacctccccatctcaaaatctgtaacttaatcacatcgtcacattccctttcgctgtgtaaggtaacatagctataggttctggggattaggaagtggacatctttgaggctattgctctgcctaccatgatagtgttcaaatttacatttttaaaaaattttacaagtaactagacctttcatattcctctgagaatattaattatactttttatttttatatttatttagttttattttattttattataattattattatttttttttgagatggagtttcgctcttgtcacccaggctggagtgcaatggtacgatctcggctcactgcaacctccgcctcccaggttcaagcgattctcctgcctcagccttccgagtacttgggattacaggtgcctgccaccgtacctggctaatttttgtatttttagtagagacggggtttcaccatgttggccaggctggttgcgaactcctgacctcgtgatctgcccaactcggcctcccgaagtgctgggattataggcgtgagccaccacgcctggcccttaattatgctttttaaaaagtctccacttaattcttatctccttgagtgtttgttgggatctggagtctactttatgaagttgtttctcatacattgatgattcttggctctgtgcacaactttttatttgagagtgcttatgaggttgcctcctgtggttaaggggaaataagggatgttctgttgagtgcagtggactggtttctgtttttctgattgtttctatcatccatggcactgccctgactttctgtttcagatgcccacactcactcagtaccccttcctgaaggcagttgccagggctcctggcactggtacaaacccaggatgagtggactcacctggctgctcttttctcagaaagccagccagctttcaggatccacttacactgagttttgagcgcccttagacttcactgtcacagcattccgctttgggagccattttgaacctcatttcctccatctgctgctttccatcttccaggcattcttgtattcctcataatttctggtctaccagcagtatttagtctcattttccaacattatttgcaaccttaaaaagtcctattttgtaagtgatagggatttggtacatgaaaggaaggctgcagtcctgtacttcattgtgccatattaatggaaatttcccttaagacattcaatgccacttatctcactggttgcatctttgcttctccccaggatggctttaggtgctgaatggatagagacaaagaatcttgactcatatgatgagaaaatattctttttttcaattctcttatattcattccaatttcaaggagataagctacagttttgtgctggagtatttttaatgttcaattttaacagagaggagaggcctccggttaaaagtcatttacagactacagaatgtatcttttggatgtaataaaattgtctattttccattgtaattattttcatgcttacagtctctatagcatgtggtactagttttcagtttacattttttgatgtaatgtttcagtgaaagttatttgaataaaattgattttataaaaaacgtatcaagaggatacttaggtacaattctctgaagactattttttgttgtttgtttttaaagattttgatgaagcagatatattttcaaggtagaattcattggtgccaattttctatctcttcttatttacttatttttttgcgctttatatttctgtagttgggggagaatttcaacttcccatgtgaagcactccccctttcctttctttatttttttggtattctaatttttttccttaggtttttgaggaacaggtggtatttggttacataagtaagctgtttagtggtgatatttgtgagatttcagtgcacccatcagccgagcagtgtacactgaacccaatttgtagccttttatcccttaccccttccaccctttctctcaagtccccaaagtccattgtatcattcttatgtctttgcatcctcatagcttagctcccacttatgggtgagaacacatgatgtttggttttccattcctgagtttcttcacttagaataatagtctccaattccacccaggttgctgcagatgccattagttcatttctttttatggttgagtagtattctaccacatatatataccacagtttttttatccactcattgatgggcatttgggctggtcccatatttttgcaattgcaaattttgctgctataaacatgcgtgtgcaagtatcttttttgtataatgacttctttttcctctgggtagatacccagtagtgggattgctggatcaatggtagttccacttttagttctttaaggaatctccacacagttttccatagtggttgtactagtttacattcttaccagcagtgtagaaatgttcccttttcacccatccacgccaacatctattttttttaatattttgattattgccattcttgcaggggtaagttgatatcgcattgtggttttgatttgcatttcccggatcattagtgatgttgagcatttttttcatgtttgttggccatttgtatatcttcttttgagaattgtctattcatgtcgttagcccacttttagatgggattgtttgttttttttcttgctaagttgtttgagttccttgtagattctggatattagtcctttgtcagatgtatagattgtgaagattttctcccactctgtgggttgtctgtacactctgactgttccttttgctctgcaaaagctctttagtttaattaagtcccagctatttatctttatttttgttccatttgcttttgggttcttggtcatgaagtctttgcctaagccaatgtctagaagagtttttccaatgttatcttctagaatttttatagtttcaggtcttagatttaagtccttgatccacgttgagttgatttttgtataaggtgagagatgaggatccagtttcattctcctacacatagcttgccaattatcccaacaccatttgttgaatagggtgtcctttccccactttatgctttcgtttgctttgtcgaagatcagttggctgtacgtatttggctttatttctgggttctctgttctgttccattggtctatgtgcctatttttataacagtaccatgctgttttggtgactgtggccttatagtatagtttgaaatcaggtaatgtgatgcctccagatttgttctttttggttagttttgctttggctatgtgggctcttttttggtttcatatgaattttaggattgttttttctagttttgtgaagaatgatggtggtattttgatgatgggaattgcactgaatttgtagactgcttttggcagtatggttatcttcacaatattgattctgcccatccaagagcatgggatgtgtttccatttgtttgtgacatctgtgatttctttcagcagtattttgtagttttccttgtagaggtcttttacctttttggttaggtatatttctaagtttttgttttgcagctattataaaaggggttgagttcttgatttgattctcagcttggtctctgttggtatatagcagagctactgatttatgtacattaattttgtatcctgaaactttgctgaattcatttatcagttctaggagctttttggaggagtctttagggttctagggttttctaggtatacaattatatcatcagcaaacagtgacagtttgacttcctctataccgatttggatgccctttatttctttctcttgtctgattgctttggctagaacttccagtactatattgaatagaagtggtgagagtgggcatccttgtcttgttccagttctcagcggaaatgctttcaacttttgtcgattcagtattatgttggctgtgggtttttcatagatggtttttattacattgaggtatgtcccttgtatgccgattttgctgagggttttaatcacgaagggatgctggattctgcaaatgctttttctgtgtctattgagatgatcgtgtaatttttgtttttaattctgtttatgtggtgtatcacatatattgacttgcgtatgttaaaccatccctgcatccctggtataaaacccacttgattgtggtggattatctttttgatatgctattggattcatttagctagtatattgtcaaggatttttgcatctatgttcatcagggatattggtctgtagttttcttttttttctatgtcccttcctggttttggtattaaggtgatactgacttcatagaatgatttagggaggattccctctttctgtatcttgtagaatagtgtcaataggattggtaccgattcttctttgaatgtctgatagaattcagctgtgaatccatgtggtcctggacttttttttttttggtaattttaaaattaccatttcagtcttgctgcttgttattggtctgttcagggtttctctgaagactttttatattgtattatgctaacactagtttgtgtctcaaaaaaaaaaaaaacaaaacataaaaccgaaatgcagtaaaataggatttcctcactcctgccacagtccagggagaatattccaagaagataggtggttctaatgcatagagtctctcaggggtctaggctgatggcagctctgccatcttcatcatatggcttcctagttgttgccactccagccagcaggaaggggagaaagaacaaacatttaggttagatatttcctcttacacccgcaaggtggaaatgacacacacattccagggatgagcgctcaaacagccacacctagtagcaaagcaacttgggaagtacaacctctagctaggcagctgctatccagttgtaatggcatcttagtttgtttgggctgctgtaacaaaataccttagactgggtagcttttacttacagtctggaggctgagatgtctaaaatcaaggtgccagcagaactggtgcctggtagaggccattcctcatagatgacaccttctagctgtgtcctcacatggcagaaggggcaaacaagctcccacaggtcccttttataagggcacaaatcctactcatgacctaattacccccaagtcactaattctcatgacctaatcacctcctaaaggtcccagcccttaatactattgcattggagattaagtttcaacagatgagttttgggggaacacacacattcaggccatagcaaataggaaatacactgcatgtaccagtccataacaatgatggactcctgctgggcagaaatttcaaggaccccctaccctggcagtgaagaaagtgtcttgattagaccctggttctgctctctggattttggatcagggagactcttttgtcttttattctgtgggctcctagatttgctctctgagaaatgtgtcttccaagaccacattgtaagtgggctttggagggctaccttctttgacatctgtacttattgctgctcagggaccttgtgggttccttacagtttagtagacacagatgtcttcaggctaggcttatgcttcttttcacaacttgatttccttttttttttgagatagtcttgccctgttgcccaggctggagtgcagtggtgggatctcggcccactgcaacctccgcttcccaggttcaagcaattcttgtgcctcactctcctaagtagctgagattataggcatgcaccaccacgcctggccaatttttgtatttttagtagagatggggcttcaccatgttggccaggctggtcttgaactcctgaccttgagtgatccacctgcctcagcctcccaaactgctgtcaccacactggccacaacttgatttcttaaaaaacgtaatgagcttctgatctatatacctccaggcagttccatgtgcctgtaaacacattcaaagttctttcttagatatagctcttaagactttcatttctttccttccttgtcttacccatgcttcgctttcttaacttacagaggctaccttgagaccacctgaaacagcagatttgagtaggaaggtgacacctttcgttgcgtctttgccacacagctgagttcctttagtttagggaggtctctgagaatgatttggaagagcaatctgcttatcttgttttctttggggtacagaaacagtttgcttttccaatgcattaggaaccaacctctgctctttcttttatctttgcttgtagactgggcaacttttgtctttcttatagtaacttgctacacacaccaaggtttagctaacatccaaccttctggctttattcaccttctttctttagagctactggtatatggtctgctttaagagttattataggcaaaaagtttttcaaatgttttgccataatctaacaggtcactgggtttcagcccggtgcggtggcttacgcctgtaatcccagcactttgggaggccgaggcgggtggatcacctgagttcaggagtttgagaccagcctgaccaacatggagaaaccccatctctactaaaaatacaaaattagctgggcatggtggcgcatgcctgtaatcctagctacttgggaggctgaggcaggagaatcccttgaaacccgggaggcagaggttgcggtgaggttgtggtgagccgagatcgcaccattgcactccaggctgggcaacaagagtgaaactctgtctaaaaagaaaaaaaaaaagaagctaggtataagcaaattaactaaaaattttgacagtgagttcaacctcagcctccctccttcaatgccagtatattatatttgaggaaatgagaacccaggaccccagggctcagtccttgccccactgtctctatctttccagcttgcacccgagtagttcttagagacaggacctcaggtcaagctcccaagacaccattctctcatttgccaccaaagagaactcaactttcctttgatttgagctcacagactggcagtgtagagagtgttaagccttataaaaatgaaaaggtatttgaattaaagtatcccttaaggtcatagggacctagcctttgagggccaacagtatgccaggagttattatttggtgctttgtagacatagacataactcatttcatcctcataaccgtactccaaggaagtgataataaaaaaaagtaacacataataagataatgacaatagcaactacacttattggctacttactatgggttagatattgtataaatactttgtatacatctctagtactatttttagtccccattttacagatgagtaagtagaggctctgagaggttaagtgagatcttctcaagatcacagagccaggaagtagcagagctgggtactttaccttatagatatttcatgttatatcattaagaaggaatactaggggaatgttatgaaatggccaagagcattgggaatgatttatttccaagattcatgattacagggaatctgtggtcagcaggtggttgcacagggagcccactaaatgcatctgacttggaagggaaaaacagaggacagtgaggtctttggcttcctcattgaggccacgcatgtcagtgctttgtcccctctttcttggccagtagctgggtccctagacagattaagttcctagaagggcgatgtacagagatcacagacgtgcagaagctggcttttaagaaggctcagtgtcccatattctccactgcagcaaactctactgtgtgccactgtgtgtcttttgcctgtgcctgtcccaggctgcttcttctaagtttccctcggtagtagcttcaagttcccgtctcacacacccagcattgggcttccttgatttgtgggtggaatttgccagtgtaaagggggtcctgtactgtttgtttctgaggcacagtttcaaaagaaaatgacatttatagcctgcattaatgggaaattactttccattaggattctgaatgatttgcacataatgtttataaagtgaaggaaaaatgtcaagcatttcactaacaaatgaaagcaaagctcatgagactctgccagaaatgaattccaagaacattttcttcatcatttcttctttctaaagaaaaaaagagagagatgaaagaacataagtcaattaagcagaatgcatcgtgggactgagatggaatctttgataatatcattgctaggtagttaagagaatgaataaagtgagccaaaatggagaaaggggagaatcacatcttgaaatgacagattgcagacaaaatccaactctaggtcctggctgggagaaacgagtgcctgtccaagcccgcgagtgtggggtcatgctgtttcatcagtgtaagctgcccctctgtccccaaagagaaaaggaggccaggaaacatccttgagttgaaacatgtgcctgtgtagctcccagaaaaccactgatgttgaagaaaatagtgtaggaatttgtgacccatgctcaagtatcttccccacttgtggggaatttgtatcaggtcccaggttgtcacctcctgaattatatatttaaagactagaggacaaagtgtattttatcaactcattttttatgaagtttttttttttcttgctgaaactcttaaaaggggtaccactttgtgtaatcacaactaagggttaatatgccccaaactgggacctgctttaaacatataggaggctgaaattagttaacaaatatgtattccaaatgtgtgctacaggcacatcagagtgagttgaaataaatctcccaaatggcttgtattaagaccttctaattctctaggtataaaagagacttttataaatttcttcacacttctaaggcagcttggaaataatttctagagcctaaatccttcccctcattggcacaaaatgtctaggattacattagaaaataaacatttattcaaaagtgaaatgtgaagtttgaaaattaaagatgaacactttgcaaatagaaatatatgcaatttttttaacctacatttccgaagaggaaattaaaatttcacagaacagtgacaatggtgattgttcggtcagcaggttgtttcttacatttctcttctttccttcctcctcttttcttctattccccttctccactaatagccttccccccagatccatttctatatattataagtagtgcttcagagtcagagttattgacaagagagaaataaataaggaaacaagagtcccatgttatagttcagattctggaacttcttagttgtatgagttggggtgagtttcttagcacctctagaccgatttgaacttgttcctagaggaagtgattggacttaatacattccaaggtactttctagctctaaattctgtggctgtagtagttgtcttttgtgagtacttagcattcttaataatttgaaatgtggacaggttgaacatttaaatattttctatattttaaaaaatgttttaaaaattaaagtgtgaaatatgattattattgttgatcagtagccattggtgcggtgaacaggaagagtctctctcttattttccaatttgaaggaagatttagagagggaagttttcctcactgcagggaatggttttctgtaattattctgaacagtctgtaaaaagagttttgaaaagccgtaagacataaattctaacttagttgtgggaattttgactttgctgaaatgatctcaagtgctgcatattttcaaatcttaacatatactctataatgatacatttgatccataagctaaaatgtaaaataccatcatctaaatattaatttatgtacttgttttaaaaaatacggtagaagtcagttgtttcctgggattacaaaccaggcaacagtgatgttgcaccatccagaggactctgagtccatatgaatgacagcccctagagttgtccagtggatgtggctgcaagtgcaaacttgaatgccagattttaggaatgagagacataggaaaagtgtaagaaaatagtgcaaggctggtgataaatggctgactctaagcttccaagtcaggatcatgacagagggaggtgtgtcttcaacaactagaaaacacttgttctttctgaagggggtggccgatagtctacggcaagcgccccttgcctgagaatgtgagcccatcatagctagcctttctgatttttcaagagaagccagaaaccctatgtttatgtgacatctcctgacttttagatgttggcaactaatccacattgtaaaaaagcaaggagcaggccagacgaggtatcatctgcaagctgatcactatgccaatggccagaaagccaactctaattaaggcagctgtttgcatttccattttccagaactcagagtggcaaataataataataataataataataataataataataatacaaacaacaacaacaaaaaaaacaacccacacacattggacctggttgcaatagaggggtcacctgccagaaagtttattttgataaataaatggcccgcaggttttgaggtatctgcaaaagtcatcacaatagacaagtcattgttttgtaaggtgggggagggcaaaactttattagttaaacccatctaatataacccgagtaaattgaggaagattggcattaaggttaacataaatcacacatgcttatttttacagatttcaatgattaagcttgagttccattgacaagtaatttcaataaatcacatctcctgtggataaatacagggctgttatttctagaaagacagcagttcattgacttttactagattttacttagtagtgcacaacttaaccctcatagaccaacacttcaaatttccagataaggaaatcaggacccaaagatgacctaatccatagcaaagatgcagggatctgaagcttctgtccagtgcgctcttacccatggacaaaaacaatatgttagagatgttgaactagatagtgtctgtggtatctatcagcattagacaccagtgttgtatctgggtcagatagagagaaagtatgtgcttcaaatgaattctgctataagaatttgagattataaatgggaaaaaagaaacttttgaagggagtttaaaccagatatgcttgtttgaactcagaggagatggtatctcacagattgagcacggtgcctggctccatgctcctggctccatgctttcaaacactcggtgagagtttgaaaatgaattggaaccagaaataaacctgaaagttccaaattgggtttctacccgccccccactccccccgcccgcccatggtaggagatgaactgtctagtctgatggtgcaggtacagtcaaacctcagggtaacctgggttctgggatcgaagcttctaggagacttggggtcccattcctgactggggcatggactcccctcatcaatggttaccttcctctctgttcatcagctgctctacaagtggtgtaagtaataagggaacatgtttggatttcctgacttcaggccaggaagtgagcggaatataagcccacccagcccaaaggggtgttaacctgccttgctggaaagtgggctttggagtcagagggaagcccagatcctggctcagttcatacctttgggtctcaatttcgtcatctgacgagtgcggattctcattgctacctcacaggattattctaaggattaaattagatcttgtgaattaggggtgctgggaaagggactcggtacagagtaggagcccacaatgcagcgctgttaatgttacataatcggttatctgatttcccagcctacagcagactggaaccagcagattaggaaggcccaagggactgcttcgggaaggccattgacagcaggaaaaagtgacaggtcgcagccagactacaagggaggcaagagaaaaactataaaaagcaggaacaaaaacactcaaaagacacagcagtctgggggatttactaaaagacaaagagccctactcaggtcagtagcttctgggagactccataccttgtaccccaacagggacttatgttgacagcgttgtatgaattacttctctctccatcccctttgccccttgaaataactatgggggtggggtcatagtttgcctttcagtggggatgctctgaccgaatgcttccaggtcatgaagttcccaaagtcaaggccagcaaaggagcaagcacagtgggctccttcggtggtctgaaaagaacccaagttccacaaaagagctgtgagttttagtgcaacagagagaaggatgccccttgcgccactgaccactctttccaccttcacctcccttaaagtcagggttagagatggagccctggagaacaggcttccagatcctggcatgtgggagagagagagagagaaaatgagaaggccaggctgcagacacgccagtcccttctgatgccatctctactctggtgtctaatccaccacctggagtgggcactgtttttaactgaagcctgagctgctcactttgaagctggaactcaggctgaagaaggcaggacagagactaagtgcctggaagttatccctcaagtgcgacaggcaaggctaggtgggacctggacagaccttcctggggatctgcgtaggatttaggtagagaatgctcttagagagccttcaaaggcctgggagcatcctgaggtatgctgagctgaggacccaaaggctcattccaagcccagctgatgggccaccccattgaatgggattggctcagaaatggtgtgggagaaggctgggcgtggtagctcatgcctgtaattccatcactttgagaggccaaagcaggaggatcacttaagccctgaagtttgagaccagcctgggcaacatagtgagaccccacctctatagaaaataccaaaattatccgggcatgatggtgcctgtagtcccaggtactcaggaggctaaggtggaaggattgcttgagcccaggaggtcaaggctgcaggccaatagcagggcactgtactgcagctcgaggaacagagcaagacagtctcaaaaaagaaaaaaggaaaaggaaaagagaaaagaaagaaaaagaaaaagagtggggataagaccacaaactaacaattttcagggggtatattgcatagggatcaagaacgtggactctctacctggcccgaggtcaagtctcagtgttgtggcttaattgtgttaaatttgtgtcctcaatttctccatccctcacattgggggaaatagtggtacctactcataggatttctctgggaattaaatccataaatccactaatatctctgagacacttaaaatattgtcctggcacatggtaaacactaacacctgagagttattatttcgtccctgtagctgagtagggctgaggaattgtaggattggaccgcctctaccttaataaaatgtgctcagcatttctgcatatgcaagtaaccctttgcagcagcagggacttcagccaaaaaatatatatatatatatataatatgtatgtgtgtgtgtataaatgtatgtgtgtgtgtctatatatatatatagagacaaaataagtggagttgggggaggggcaccgcaaataatgttcctgctgttaaaataagagggactgaaccatattaatgccaagggggaagttcagtttatttcaggggggacgtggttttcctacctcctactgtgttactgatacagtacttactgaccagccgtcttaaactcttgtggtagggtctctctctctctctctctctttctctttttcctaatggtgtggaacagagcttgaataataaatatttaacagggacactcccttttctctgttaaaataatctttgtttcaatactttaacaaggaagactgtgttttcccacctctgctctcacgtttcgttgaagccaggtctcaggagtaagagaaaatcaacacaaggccacttggggagggcagtgctggctgaagccgtctcactggacagcccagggtcaggggtttcagccgcctgttcaaggacaccgagatccacagcagccacctgggagctcctacacaactatgcccagcgattccaggtgccagctactgaatgtgagagagcaaggaggtggaggtggatgaggaactgccagctgcaggaccacaggggcaaggggaaggggttgtcaacagggatgggacgctgggtaggatcagtcttttcttacgagacgttttcagctgaggtgctggcttctgatggtgggaaaccaagcattcaggtcccttggagaggcttatatctaacagttggaaagcctccattgaggaaatccagcccattctgcctggactttggggctccatccatggtgacttttgtgtcaagggaaaattcacacactgtccctcaggcgggcagcaacttaatttctctttagctgaactgaacttgcttgcaagcctctatgtagaccaatggcggaaacaacttaatcttttttccatttctgttgttgaccaaaaaaaaaaaaaagctttaaaatcttttttccatttcttctaatggtggaaaaaagcataatcttgccatttcaaggtagctcagtctcttccaatagaaagcatagactatccgtttatgacttaggcgattccagatttaaacacagtcaattcagagtagaaattccctatcagggctgttggtttttcttgaaggttctctcctccccctggtccagtcctaagatgttgcctagatgtgaggggggtttacagaacatcatggtggcaggtagggaggctcacttccacagctgaggtgactcgtcacaggaggcctggggcctgggccaggatctgtgctgacatctgtggcttaggcctccctctctgggttgctgaatctctgtatttggagccgtgtgtcactgcccccaggcagcctctggcctcagtggcccctcagcacttcctgctggggacttgagggaatttgttcacagttcacagggagcgaccagccttcaggccccatctgtacttagtgacaccacatggtttccactgggctccagcccccgtgttagtccagagaactttgacagctgccttctcccgggatttctgtggaaagtggagtctaagacccccttccccagggtggcatccaaggagcatttcaattttcttgctcaccctcttctcactgcaggccccttccctgcttccctgcctccagaaagagcttgtatctcttctctggatggcaggaaacagctcctccctctccatggcttgtaatcaaaatgctaggctctgagttcttcaagctctagttcttggaacccagaagtttctctctctctctcgctcttaaatcttataaaagcctacctggctctagcatgaaagcctaaaagccttggctttcacaatgtttcacaactgaaatggtattatttgggaatttaaaagctaaacattgactgctttgttcatgtctgggttccaccctcctcctcaagtaagggaggcaagccccagctccttgggttgagggccccaggcaacagaaatgacccagaatgaaaaatgcattgatacttcagaatatcgtccggctgcatgtataattcagggcagccagtctgagctctggttggggtggatttaccaactgcctacttagcaagtgccaattgctcttagtgttgtagccagcccagtggtggctggagggccaggtgcacttgtactgcctgagtcagggagttcttgaacagggtctttctactcagtggtctctggagagatgccctgccttgggtttaggtgctgatggagtgtgatatgagtgctggtctctttccagctctcagaatatcaaagtgggcaatgtggcagtggttccttgccaagaatgaatgacatgagaagtgagtaatgcagcttttccatgatttgttctgtgtgtgtgtgcagcaagaacccaggtttacacatggaggtggtggcctggtttacacatggaggtggtgcatacacttggacaaatgtatgcttgccactaagcattttggtcattgcaggtggcttatagagtaaatgggagggaaatatataaatctatctatctatctatctatctatctatctatctatctatctatctatctatcattagccctgtaatcagtgtgtcagcctatgaaatgtcttggcaacccttagtggtgtcatagatcatgtacgaggtgacatggagcaaggtagctgatggcctagggtctggagccctcctgtttctggctcagccagtagccctggggccaggccattatgacctctcagaggcattgatggcttctcttggaaaaggagaggactcatggaggactgccaaattccattctagcattaacattctgtgttcaaggaaatgcttcccgagactaccatgtggtttggcacctgaccccttctctgttaaaaactagtctagtagtgggagaaatgctaaaagaataataattatttttataatccacattaaaacagttatacattaataaagtagactttgactcacagctcaggttgcccttggttttcagtgctcagcccccacctgcccacccatatacacactccatgacccaaggaaaatgaaaagttctgtattgtaagccctctattccccatgctttgtttgaaatcattgaatgttgttctgttcaaattcaaaatagtgaactaatccccaatatttacagccttccaccccctagctttcatcattatgacaagaggaatacacagacttaggcaggggtggggtctgtcacggaaggagctgtctagaggctagaaacatcatgtagatcatagaggttatattgcaggtgggttcagagtttcaaagtcacgacccagtacaggagctgcctccctgaagaggaagaagagctcccctaccattacccccttctctttcctcgccagctgagtctctttaacctttaacgcttccttaggggaaggagaggggaggatcatttcactggtggttgtcaacctaccctggacataggaaggacctgagaaacaaaaaatactgatgccgggttcaccctgggcagtgggctgtttagtgtgccaccaagttgagaaccactgccataggaaggcaacaggaagccaccttggtacaacctggggagctccgctgatgaaggctccttagagtgccctgttccttagagatataggcgctactccatgaatttcaagctgtctaaacaactataatataatccttctcacaacaggaatctccattgccccaactcttgtcttcctcctcccataatgctgtcacctctctacccctccccaggacaaaggggcatctcatttggccagccacagaaataccccaacgtacctattctctttacttggacctagaagacttagtggagaaagaacataatctctagcagaacttgttcaattctcacttgaagtctagagggaggaaaaagtcttataacagaaaaaggaaataaaaatggaaatcatcaaataggatggcaaaagtcacttattaagaaaaaaaaaaactcctaagattaatcttattaatactcaaagaaaaaaagtatgaactagtcaaaattgaagtgagatttttgtgagagaaatgtgtcatattaatactgaaatatacctagttaaatgaattcatgagaatagcaaggaaatattgaaatagaagggtaatgactatgaactagttttactagttattaacattttatttatttatttatttttgagatggagtctcactctgtcacccaggctggagtgtagtggtgtgatctcagctcactgcaacctccgcctcccaggttcaagtgatcctcctgcctcagcctcttgagtagctgggattacagacatgcgctaccatgcctggctaacttttgtatttttagagatggggtttcaccatgttggccagggtggtctcaaactcctggcctcaagtgaactgcccgccttggcctcccagagtgctgggattacaggtgtgagccaccacacccggcctgttaacatttattataaagccacagtatttaaaatgatatggtactgttaccaaaatgagtcagtgggacaaaatagaaaaaatccaaaaatagatctaagtcccatgatgattaaatatatgataaagataaaggcaatacttgaaatcactggagaaaatatggattatttaagtatgttgttatgactgcataagcattattaaatataatagatatttacctcattttgccaaaatccaaatagattataaaagttctgatgtgaaaaaaattaaataaaaatactagaataaaatttagttgagtctttatataggactgtggagaataaaccatgaatagaaagtttgattagtttgactgcttatactcttcaatttgtgcattcatgccaaaacaaaatagaaacccctttccctgccccactgccagcacaaacttcaaaaacaaaatgagaaaaaaaaagaacagatgataagttgggaataatgtttgtaccagaaatgacagataaagggtaaatatgtgtagtataaagggacttctaaacatcttaagaaaaatagtgatattaggttggtgcaaaagtaattgcaggttttgccactaaaagtaatggtaaaaattgtgattgctttttttttttttttttttgagatggagtcttgctctgtcccccaggctggagtgcggtggcgcgatcttggctcactgcaacctccgccttccgggttcacgccattctcctgcctcagcctctccaagtagctgggactacaggtgcccgccaccacgcccggctaatttttttgtatttttagtagagacagggtttcactgtgttctcgatctcctgaactcgtgatccgcccgcctcagcctcccaaagtgctgggattacaagcgtgagccactgcgcctggccactgtgattgcttttgcaccaacctaatagaaaaataaattgacactaaatgtcagatattttagaaagaattcatgttctatgaccatgaaatccttttcttggaatttatcctcagaaattaatagtgcacatttgtagatatttatgtataagctctttttcccaaagaattgtctataaaagccaagggggaataaaagagacaacagaaagaaatgaagaaaaaggaagagaaatcgagaaaaacagggagggagaaggaagaaaagaatgaaggaaggaaggaaaagaagagatgaaaagaagagaaggaaggaaaagaaagaagaaccgtaaatgtccaacaataggagattagttgaagaaatgttacattgtgagagctgacagctagtcagtaactaaaattgaaagatattcaccctagcttgtacaagaagaatcttttatgaaaacaactatatgtaaatatatgcacaaatataatcatgaagacatctggaatctgaaagctagcccagttatctctggggtaatggtttacagctctgacttttctttctccactttgcatacatgtattttttgtttacaattagcatgattttgttttgaaaaaaatgtttttgatgttattctgggactagatgtcagtaaatattcttgtctgtaaattctggtctgtaaatattcttgcctttcttgtcctggtttctctcctcccggcccttgtcctgcccattaactaggaagatcttgctgaccaccaaggtcctccctactaccctctccccagagctcctgaaccatgagtgatacacacttcatatttgttctttaaaagatttttggccatgcacagtggatcacgcctgtaatccccacactttgggaggttgaggtgagcagatcacttaaggccaggagttcgagaccagactggccaatatggtgaaaccccacctgtactaaaaatacaaaattagctgggcgtggtggcgcatgcctgtagtcccagctgcttgggaggctgaggcacgaaaatttcttgaacctgggaggcagaggttacagtaagccaggatcgcaccattgcactccagcctgggcaacagagcaagactctgtctcaaaaatagataaataaataaataaaagtttctcgtgtattttctaatccccacaaagaaactgtaagctcccagagagaaggaggtgggcctgtgattcctctgtcgctcccttagggctccaggtggagctgactggctgcttttgggagatgggctgggcacgacttctctgcctgggagtattgaaaagatagactctgggctcatggggttggcgcaggcagctgggagagctgaggcagccagagaccacaaacggcaccgtgagctgggtggagctggccttgtgggaaggaagcaaggcctgctgttaagggtctctctgagcttttccacatttccaatttcccatggataatccatcatgttcatctgtactttttgtctccatatcatgtggacaggttctaacattcccatggaccagccctgctgtcgtggtctctatgactttgagccagaaaaccaaggagaattaggatttaaagaaggggacatcattacattaaccaatcaaatagatgaaaactggtatgaaggaatgatacacggagaatcgggattcttccccattaattacgtggaagtgatcgtgcctttacctcagtaaatgtgtaacacaaactctggacatactttcgtaactgaaatgaattcacaccagtgtgctctcagtgcggtgttctgtgacatcctttgctctctgaccaacttaatgacttttgtatgtgtgctctctttataatgtattttatatcactttaatttgtataaatgattttcttgtccttgctacatgaaaatattttcttttttgcttcctgtcctaaaagtcattggttaaatgtatttgcttcctgtggctaaaaataagtctcacccattgcagttatgtcaacgaatggcctatattcctcagctgcaatgaaatggtaacatttgaaactaagaaatgctaaatattttgtttctcgacattcctgatgacgtctggtcttttcttttcattgtattttaagcttacctgtgaatagcccaataaacatgacacactgtgttggcaa

SEQ ID NO: 454 - DNA, 171403 bp, Homo sapiens; identical to SEQ ID NO: 453

SEQ ID NO: 455 - DNA, 146573 bp, Homo sapiens
gttgcccgggtgacggctgcggaggtggcggccgggctgggatagcgcgagtgtccgcggccgagcagcaggtaagcgcgtccccggatgcagccgggccaccctccgcccgccgtcctggtgctgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccgcaagtagtccctgatctttgctgcagtgggccatacttggagggggtccctcaagccatccagctggtggtggcggcgcgagcgggttatccgggatttagatccccctgataatctccatctgctagccgcgttcctgaggcacccagttgaagtccagacttcacctaatcttaggaaaaacaggatgcgtgctatgcagattcggcttccatacaaatcccataatcccacccgtttgtgggccctaaatctttcttatataggaattcaaaagctgccgctgcaatccccaaatgtaactggaaaagtttttcttagtttccgcataaaggagagcactggttctcaaacttgagagtgtgtaaaagtcactcagggagcttgtttaaaaggcagatttctgggcatggtgcctgccacggtgttcagtaagaccagggtggaggcaggaattttcatttgcacaagcgtgccagctgattctgatttaggtggtccagactttgggaaatactgtgtagtggttcttttcagccgcttagtcacttactgtggctgttgggagtgtgtcagacttcctgggcctcaaattgcctcatctggaatgggaaaatataaactatattcacctgtcaggtttactatgaaggttaaatgtaaaacattttgcacattgcctggcataccatataccttcaataaatgatacctattatgatataaaagtttagagaaaattctgtaatttctttttcttttcctttttttgagacggagtctttccctgtcgctcaggctggagtggagtggcatgatctcggctcactgcaacctccacctcctgggttcaagcgattctcttgcctcagcctccctggtagctgggattacaggtgcagacgccaccacgcccggctaatttttgtatttttagtagagatggggttccaccatgttgatcaggctggtctcgaactcctgacctcaggtgatccgcctgcctcagcctcccaaagtgttgggattacaggtgtgagccactgtgcctggccaattctgtaatttctaagaatgttgagtaataggatacccagcagcactcacattcaatgacagttgatcacagcagatactatttaaacggcttagggaggtctactctaaggaggtgatgtttattaggcacagtggttaaccaggtgaagagagggaagagtgttctaggcggagagagtaatatgcgcaaaggccttgaggttggcctcaaggtttcaaattctcagaaactcacttttcccgttccagggcctttaaaatgacatcccctcagctccggcttcatttattcattatatgccttgagtacctttcttgcttactagacactctgttaggttctggggatatgaagttgaaatacagctccctgtctttgtgaacagggttataagaagtgccaggtgcagtggctcatgcctgtaatccctgcactttgggtgggtgaatcgcttgaggtcaggagttcaagaccagcctggccaacctggtgaaaccctgtctctactaaaaatacaaaaattagctgggcgttggtggcggacgcctgtaatcccatatacttgggaggctgaggcaggagaatcacttgaacctgggaggcagaggttgcagtgagccagattgcacctttgcactccagcctgggcggcaaaagtgaaactccatctcaaaacaacaaaattagctgggcgtcatggcgcatgcctataaccccagctacttgggaggctgaggtgggagaatcacttgaacccaggaggtggaggttgcagtgagccgagatcccgccactgcactccagcctgggcaacagagctaaactccatctcagaaaaagaaaaaaaaaaaaaagccttggtagggaaagaagggaggggtttttcatggaagacttcttgaaaagagattaaatctggcttggcttagaatcatgagtcatgtttgcctgggggggcagagcatacatcaaccacaggcttaggatcctggaagagcttgttgcatgggggaatggccaggagttcgctgttggcagggtccagtgtgggattggtggaagggagcaaggagagggatcaggtagggggaggtggatggattggaggcatggtccagaaaaaggctggagaggtgggtgtccccaggagcagctgcctttcttctctccccttttgcatctggcagggctggtgtggtgcatggggaggtgtcctccctgctcctcattactgcttccagatcactacccactccttcacaaaccccagctcctttgaagcacatggcagatgccataccccttgccagccctccctgaggtagccacttcccagggcaagtctctccagttcccttggagcctccagcacccggctggctgcctatcccttcatctcttttacttcacttttgggggtttccacatcctggcccctccagtttcttcatcctccttacttgcaggcgtctctttcctccatcctcctcatctgcccactcccgtggtcgggagctttttagtactagtcaccttcaaagtcttgccttcaggcatctgtcccactctctgcccactcctttccatctttcacactcactggaatgtgcctccttcagcaggtctcagaccccactgcttcctcactgctctgcagccgccttatgtgtgttcccctcccccattcttaacctgattagttccagtgtcccatcgtggttgtactgttttccctttcctctctcttctagaagaacctctcacattggttaacctaactcagatagctgaaagtgcctggagaagagctgcaaaactgtgcagactgattccattttagattcaagtgcagagatcttaaatggactataataccagcaaccctgccatgttgctgtagtcgctttggttcccaccctcccttccgttcccactctcccttctcttcgaactgtcaccatgcttcttacttgcagccgatgaccttttttctttctttcttttttttttttttttgacagagtctcactctgttgcccaggatggagtgcaatggcacgatctcggctcattgcaacctccacttcctgggttcaagcgattctcctgcctcagcttccagagtagctgggattacaggtgcctgccaccacacccggctaatttttgtatttttagtagagatggggttttaccatgctggtcaggctggtcttgaactcccagcatcaggcgatctgcctgccttggcctcccaaagtgctgggattacaggcgtgagccaccgtgcccagctgatcttgtttcttgtttcactttttttttttttttttttttgagacagggtcttactttgtcacctaggctggagtgccatggcgtgatcccggctcactacagccttgaccttcctggttcaagtgatcctcctgtctcatcctccccagtagctgggattacaggcacacaccaccacacccagctaatttttgtatttctgtagagatgaggtttcaccacgttgcccaggctggtctcgaactcatgagctcaagtgatctgcctgccttggtgtcccaaagtgccaagattacaggtgtgagccactgcacccagcctgtttcacttctaatcactaaatctgtgtctttgctcagcacccatattctctgctatccctctgaatgccgttcctgcttctcccttaaactccaggctcatatatctgtaagaattaaagaaagaggagagaaacacgaagggtgacttgacagtcaacaggtttgtttcctgggtaacggccaaacttcaccctcttacaatgggcctcagtataacagtgggccttaataaggacattctgttcccttcaggtgcactaagggaagctaaaagcagacttggggggtatgcctgcagctgcagaaagttgtataggaacagacacacaactctccctcccagataagcacaacagagagacacagaaacagttcaagcctttgataaactctcccaccctgaatccttaaaaactcttagtctgtaggagagtgtggctctgacctaactcggtcggaagtccctcccaggtttgaaataaacctgttgactgtcgagccacccttcgtgtttctctcctctctcctctttctttggttcttacaatacccactgaccatttcggaacctccactggaatgtctaacaggcagctcagacttatagccaaaacagagctcttggtttgacctcaaaacagtccttccccaggttttcgttgactcagcaaatcacatactcttcggccagctgctcagatcccagggttcttccttcccttcttcccctcatgtcccacaactaactggtctgcagattgtgcctcttctgccttttccatctggactcacagcgctcatggcccctcttgcttatccaaatgatgctcatggctggcgtggcctgagcagtactcatctccctcttcccactcccctccagtcttctctgtagagcaggcaacatgcatattaaaaaatggacatcagcagccgggcgtggtggctcacccctgtaatcccagcactttgggaggcagaggagggaggattgagcccaggagttcaagaccagcctgagcaatggtgaaatcctgtctctgaaaaaaccaaggctgggcgtggtggctcatgcctgtaatcccagcactttgggaggccgaggcaggtggatcacctgaggtcaggagttcgagaccagcctggccaacgtggtaaaaccccgtctctactaaaaatacaaaaattagctaggcatggtggcgggtgcctgtaatcccagctactcgggaggctgaagcaggagaattgctggaaccccggaggtggaggttgcagtgagccaagattgtgccattctactccagcccaagcaacaacagcgagactctgtctcaaaaacaaacaaacaaaaaaaaacctcaccaaaaaccaaacaaatgaaaaaaccagaaaacaaaagacttggggcatagtggcacactctgtaggcccagctactcaggaggctgaggtgggaggactgcttgagtccaggagtttgaggctgcagtgagctatgatcatgtcactgcactctagcctgggcaacagagggaaactctgtctcaggaaaaaaaaaaaaaaaaaaaaaggacatcagtggtgtcagtcccctcctccatactctctctgagcctcctgttactgtcagcctaatgtccaagccacttaccagctctgtaaggcccacctgacctggccccggccccccattgcctgctgctgtctgcctcacccctagctacatcccaataccccaagactgcagagctcttcagcctgaggcctgtgcactaacaaagccatcttccccagatccaggtgctcaatctttgctgaaatgtcacattcccagtgaggccatcaaccactctatctaaaataaccccatacccgtctccttcaggttctgtccctttccttgcgctgttttcttcatgtctggaatcaatttccactccgtccatgtttttgagcctgtactgtgtgccaggcactggtctaggcacaggggaacacctgtcaggtgctgttgagaaaaatcaagcagtacaaagggctgagaagtgatgggccgacctcttagaaagggtggtcagggcaagactctctgaggaggtgacagttaggcagagacctgaatgagacgtatctgaaggaagggcagtgagccagagttcacgagggcaggcgtgtgctttgggtgttcagtgggtgtccacaggaaccacacagtggccagtgtggctcaggtttacagaacaaatgggagtgtgtcagaggccaagttgtctagggctttgggagttgagcctaaggagcctggccttcatctggagggcgctggaaccacaggagggtcccaagcaggaggggaatgctcacttgttaaaagtgtagaaattggattgaagtggagagaaaggaggtggggaggcagtggcagaaaaatgtaaggttacagactcagaagagatctgactgagtgtggtggctcacgcctataatcccagcattttgggaggccaaggcgggaggattgcattacccaggagtttggcagcttagtaagaccctgtctccctgtctctacttaaaaaaaaaaaaaaaaaaattacctgggtatggtggcatgcacctatagttctagccactggggaggctgaggagggaggatcccttgaacccaggagttttagcttgcagtgagctatgattgcaccattgcactccatcctgggcaacggagtgagatcccatctcaaaaaaaaaattcgatgagttctgacacattctgaattttatagatgaagaaaggctctgcacttcagtgagttgtctcagatcaggtgccagtgaatggcatggttaacattagagcccagaccttttcattcctctggggttacgggcaactgctttgggctgagcctggggtgtgggccatggggaatgactgctttgggtacaccttgagggagggctagtagaaagagtaggaagagtttcttttgactttagccattgtatttcctagtgccgctgaacaaatgaccataaactgagtggtgtcaagcaacaaagatttaatatcttctagttctggaggtcagaagtctgaaatggctttcactgagctgaagtcaaggtgtctgcagtgctggatcatttctggatgcagtgggaggatctattccttgccttatgcagtttttagaggctccttaccctccttgtcttatgccactttatcccctttaaagcctgcagtggctgttgagtctttctcacatctcatcatgctggcactgaccctcttgcctccgtctgcccccctccctctgctgtgactgccttgggcccacctgggtaatccaggatcatcccccaatttaaaggtcagctgatgagcaaccttaattccatctgcaccttaattcccccttgccgtgtaacctcacgtattcacaggttctggggattggcgcatggatgtctttgggggccattattctgctcaccacaaccacctttttgtagtttcataggtggttgaaatgaaagctgttgtcttgtatttttgccttctagagatttttgctgtgagaattaattaccagtaacagttcaatatgggggacattctggctcatgaatctgaattacttggactagtgaaagaggtaggtatattatacaaagcagaggtcacagagaaacagatcttgaaaacttgtgttttaaaatgcaacaaactatttagtgccttgtaatgtttcttctattgttatgttggagctatttttctattatataatattccatgtatttacattttggttttataactaaacaaatcttaaagccacttaaaaagtcccttgaaagaaaattataaaagcaatacacgtccacggtaaaagattcaagcactacagaagtataaaaaggaaatttccctcccagacttttttctatgtatagtaaaaatatattcacatgcctgtagtttgttttacagaatgggatgatacattgttctgtagcttgctttttatctgccaacaataatatagcatgaacatctgcctatgatcggccctagacatttgaatgccatagagtatttcattgagtggctgcatcataatttttttaactcattgtctggtaatggcctaggtttcctacgctaaaagctttgacaagtagggcccaggccttaaactttctggtgctaaagaaatggttcgcgcttgctgctgcttaactgtgtgagtaaccacctgcaggttgcgagagccacgggcctggagcagggatgaggcacccaccgtgcaactgcagatttggaatttggtggtgtgatggcgaatatattcttttttaaaaaatttacatttaaaaatctttttagagacaaggtcttgttctgccgcctaggctggagtgcagtggcatcatcatggttcactgtagccttgaactcctgggctcaagcaatctgcctgcctcagcctcctgggtagctgagactacagacgtgcaccaccatgctcagctaggttttattctaatttttgtagagataggatctcactctgttgtccaagctggtcttgaactcttggcttcaagcaatcctcctgcctcagcctcccaaagttgtgggattgcaggcatgagccactgcaccctacctatataacacattttcttttaaaaatttatttatttgagatggggtctcgctttgttgcccaggctggtctcaaagtcctaggctcaagcgatcctcctacctcagcctcccaaagtgttgggattacaggcatgagccatgccacctggcctataccattttttcttttttttttctttttttttgagatggagtctcactctgtcgcccaggcaggagtacagtggtgctttctctgctcactgcaacctccacctcctgggctcaagcgattctcctgcctcagcctcccgagtagctgggactacaggcacgcgccactgcgcctggctaatttttgtattttcagtagagacggggtttcaccttgctggccaggctggtctcgaattcctgacctcgtgatccacccgccttggcctcccaaagtgctgggattacaggcttgagtcacggctcctggccggtagttctatttttatttttttgaggaacctccatacagttttctataatggccgtaccaatttacagtctcaccaagagtgcacaagtgtttccttttctccacatccttgccaagactttttatctttcgtcttttttgtaatagccattctgacaggtgtgaggtaattaggtctctgtggttttgatttgcatttctctgattgttagtgatgttaagcaccttttcatgtatctgttggtctttttaatgtcttctttggataaatatctattcagatcctttggctgttttttaattggattatttgtttgttttgctgttgaattgaattatttattttttatagtatttagattttgctgaatttgaagacaccttgaaaacattttcaaaagaatgcaaaataaaaggaaaaccattgtgtaaaacagtaggcggatctttcagagactccaaatcattgacaattcaggtaacattttgcttatttttcatccctgtagataattcaggatgctcccaacttgtggaaaatgctgctgttggatagtgctagaatagtttttgagcacttgctcagagttactttagatggcacaagtgtttatagatgaactaataatgtcattttaaatctctgtaccctccccaggaaatgtgtggccatataagatctttcacaaacatttcttgggaagaaggaaaagaagaaaccatgcagtgtttaggaactgagacaattgtagccttcctcctgaggagtttcaggttattaattctaggcactggggatccagcagtgaacaaacaaaatccagccccttgccagcacagcatttgcattctagcttggggaggttggagggaacagggagcaagagtgagactgacaaggcgggtctgtgaaaggaagtctgaatagctctgtgaataccagtgggctgcaggggcacagaggttatacagacctcaactctcagggttagaagggaccttaaaaatccttgactaggcatggtggctgaatcctgtaatcccagcactttgggaggctgaggcaggaggaccgcataaacccaggagttcaagaccagcctgtgcaacacagtaggacctcgtttctttttctttttttttgagatggagtctctcgctctgtcgcccaggctggagtgcggtggtacgatctcggctcatcaccacctctgcctccaggattcaagcgattctcctgcctcaccctccctagtagctaggattacaggcacgtgctactgcgtctggctaatttttgtatttttagtagagacggggtttcactacattggccaggctagtcttgaactcctgacctcaagtgatccgcccgccttggcctcccaaaagtgctgaggttacagatgtgagccaccatgcccagccagaacctcgtttctataaaaaataaaaaattggccgagcatggtggcatgcacctgtagtcccagctacttaggtggctgaggtaggaggatcacttgagcctgggaaatcaaggctgcattgagccatgatcatactgctgcactccagctgtagtgacagagtgagaccctgtctccaaaaaaattaaaaagtcattattttaaccattatttgatgtctaaatctcatttgtaatatgccaggtaagtaatcagttcacctagaatatttccattgactagagactgtaccatttcctgagacagcatgtttcacatttggatgattttattatttatttatgtatttgagacggagttgcgctctgttgcccaggctggagtgcagtggcaggatcttggcttactgcaacccccgcctcctgggttcaagcgattctcctgcctcagcctcccaagtagctgggattacaggcacacaccatcatgcccagctggttttagtatttttattggagatagggtttcaccaggttggccaggctggtctcaaactcctgacctttggtgatccacccgcctcagccttccaaagtgctgggattacagatgtggccaccacacctggtctattttatttttataattaaaaaaaattatgtggagacagggtcttgctgtgtttcccaggctggtctcaaactcccaatctcaagtgatcttcctgcctcaacctcccaaagcactgggattataggcatgagccactgcacctggccttattattttaacagatttttaaattttaacatacctacttccagaaataattttaggcttggcttgcaagccccttgagtggctggagttcaagtggtattcactgctggttttctcctagtccttgactccccagtggcctggcatgggcgctgttgagagaggggcacttttgaagtggcccgtggagctcaaggcagggctgaaccctctgcctgctccgcttcaggcctctggcccctggatgctgagctgctgctgcttcctgtcaacacagactcttctgtggatgctacagcagccagacctccctggcaccccccacacctagaacgatatgttcagaacataaaagaatatagtcattagtagaggtgaaaacaggttcttagagtgaagtgtgttcctcaggaaatcagcttcactccccagcacctggcttccctggttctttctggatgaagaaagacctttaccctacacgttggaagtataggtgagcatctcttaattaaagctaccatttgagaggaatatagcaaatcctcaatacctaactagcagaacagtgagactcttttgtgaagttcacacatgaccagatgatgtgatgatacagggtaaggccaacaggccctgtgccttgaagcttctttgcatatcggtccctccagaggtggctgctgtacactttccgcaactggtttgccatcgcatttcagctccagctgcatctgagaacactcaaatgtctctttaggtctttttaaaaaattgtgattaaagataacataaaatgtatcatgttaactattcttatgtgtacagttcagtagtgttaaatgtgttcacattgttgtgaaacagatctctagaatttttcatcttacaaacctgaaactctgtccccatttaacaactccgcctttatcctccccctaggccttggcagccactattctactttctgtctatgaattggctactttagatatgtcatataaatggaattatgcagtattcgtctttctgtaattggcttatttcactcagcataatgtcgtcaaagttcattcatgttgcaatgtatgacaagatttcctttccttttaaaggctgaataataatctgtgatatatattcacaaacacatacacacacacacacacacacacccccacagtttatctgttcttctgttgatggacacttgggttgcttccacctcttggctattaagaatagtgctgttggggctgggcgtggtggctcatgcctgtaatcccagcactttgggaggccgaggtgggcagatcacctgaggtcaggagttcaagcccagcctgaccaacatggtgaaaccccgcctctactaaaaaaaaaaaaaaaatacaaaaattagcggggcatagtggcaggcacctgtaatcccagctacttgggaggctgaggcaggagaatcacttgaacctgggaggcagaggttgcagtgagccaagatcacaccattgcactccagcctggggtaaaaaagtgagactttgtctcaaaaaaaaaaaaatagtgctgcagtgaacgtgggtgtgcaagtatctctttaaggccttgctttctgttcttttggatgtatacccagaagtattgctggatcatatggtagttctatttttaattttttgaggaattgccaagctgttttacaaagtggttatactattttccattcccaccagcagtacataagcgttccagtttctctacatccttgccaatgcttgttattttctctgtgtgtttttaaaatattcaccattttgatgggtttgaagtgatatcttgtcatagttttgatttgtatttctctgatgtcttcaggtctatttttatataacttcaaagaccttgaaactttctgattgtcacaagcatatcttttctgctcatccagtcaacagctgtgtcccccactatggtagatttcccaaatgaaaaatgcctgggttgaatgaagaagagtggggaaaaaatttagaaagaaaaataaaaaaaatatgtagaactgaggttcagcaaaatatgctaattgttagtggaactcaaaaaatagtgagtttccccaagcagttttatgtgtatagttcagtagtgttacgtatgtttacattgttgtgagatataagaagcgtgtgtgtctacaagttactattgatggtgtacacattttctcatcttgttgattctgctttgatcatggtttatagaacatcactaatattttgtgactgtaagttataatagcagattcttttatgtgtgggtattattttaagctcagggaccatttccaggtacagaatgtgattcatgagttaggaagaatgatagatgtgattgtaatgacatagcaaaggtttgtggtttcaggtctacaaatatagaccttagaacaaactgtagatgggccatttgacttgtggactctgccaagccacattgataaaataacttttctttaagccataacgtttcacaagagtctgcgctcacctcatccacacagtcagagagctcttggtcaccgcacttctcatggcaaggccccctcaggaatgggcactgggtttgcttgggaccttggcagaggcaagcatggggctgagcctggccccacagcactgcccctgggaggatcccttcacctttgtggcagtcattaacaagcatgcaggtctctggtcagcttccccaaattcttccaaggggtgcctgcattcagctgcttgtgctttgttttggcaaccctcacccacaggcgctaacacactgtccctcgcctgtgtccgggaggaacagaagagccagccttgaggaggtagatgctcattgtagggcttatttgaaaaattctgagtttacttgaaatgtaactggcaccttccagcgtaaggcagtattcagagacagttcttgattacatgacatagtgaaatttttgtaatattcagatttgaggattccttaccaatcaacatctttgacttatgtgtaaccaaacactgttacattatttgttctctatacatttccattttatgttagaaaatttgcttataaacagataaaacaagtaatttttaaaaatgacaattatgcaggaaaattatctgtaaacgttttttctttttttttttttttctgagacagggtctcattctgttgcttaggctgaaatccagtggtgggatctcagctcagtgcagcctctacctccaaggctcagatggtcctcccacctcagcctcccgggtagctgggactacaggcacatgtcaccacacccagctaatttttgtactttttgtagagacagggtttcaccatgttgtccaggctcgtcttgagctcctgggcaaacgatctgcccactttggccttccaaagtgctgggattacaggtgtgagctaccacgcccggccatgtaaactcacttttttggtttttttttttttgagatggagtctcgctctgttgcccaggctggagtgcagtggcgcaatctcggctcaccccaacctccgcctcccgggttcaagcaattctcctgcctcagcctccagagtagctgagattataggcatgcaccaccatgcccggctaatttttgtatttttagtggagacagggtttcatcatgttgatcaggctggtctcgaactcctgaccttgtgatccacctgccttggcctcccgaagtgctgggattacaggtgtgagccatctcacccataaactcatttttagaagtataaaagaacaatggccaataatggtggtaaataacaatggtattgggtggggaagtggggattctgtagaaaatccaatctcagaaacgctgttgcagttgagcgtaaaatgtaagtacaaatatcttgggcattcgatacaaaaagaacagtagcaactgcattgttttggactcttaagaagttctttgacttctgcctgatacttaaatccacaaaattatgccacagatatttgtgacaggtgagttatcttccttgtgagacaggtgacatgataattgccacctcctttctccagaattctttgaactagtgcatgctgaatcatgatgctgtcattgtcccaggtggactcacacagctctgtggtcaaacggcactgagccggtgctccttcctccatctccagccttctctgtcgctgcagctgcagctggcaggcgtggacagtcaccttatggtataatggggtctgtggtggcttccttcagctccatatcagcctggtgtgcttctagcaatggggcaagtggcagctctatctcctaggcccaggattgactgggtcagtgtgtgtgggctcccagccactccaggatgtggagccatgctgtcagcaaccttccatgcctgtgaggtttgttcctgggaggcctggctagacttggtctggatagcttttgtcagttgcacgctgtgggtcagcaggtccaaagggtgacttcagtatatttacgtgtccaagagttctctggccccaagtctttgttctgtgcctgattctttccatttcaaagaccttaaatgttttgtgtgttctttatagtgcccagattagatattgcaaaggtgtgggaaaccagggttggtgtgcaggaatcgcaggctcaggagcttgaatcctgtgggatctctatttttctatcctttaccactgaaaaggagtatatgggagatctgtggtgttgagtgggttgtgagaattttgggtgttgaaatttacaacgaggtatgtagtctgatgtcttctccacagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggtgggtttacctggtgatgcgggtgggtctgagtggtgtgttaaggaacagtgtttgctgtcattgtccacatgggcatggatttcatatgtggctgtgctgtcataatgcttacgaggtacaggcatcctctctcctggtgagtgattttctactgtattcccagcagtttatattctaatttctatggagatttaataatttctgtaatcaaagctatattcctaaatacctcaagtttttgaaacctcatcaaaataaagtttatttggcaacttagtatgtaggcgtgtatgtctaagagaacatatatttcagctgcatattagaccctatattagaacataaatttatttacttatttattgtagagaaagggtcttgctatgttgcccaggctggtcttgaactcctgggctcaaacagtcgtctcaccttggcctcccaaagtgctgggattacaggcgtgagccactgtgtctggccagaacacacatttaaacttaggtagtggaaaagagtacgtctctttgtggaaagcccttttgagtgataggttgaatttagcatctgtagtcctttcccagatggggctggagatgggaagagaggagaaggctgaaatgtgaagctgctgcggtggctgagctttgagtgcagagtaaatgacagaagggcagcagaggcaagctggcatttgaccccgtgcattaatgactgccctatggaccaaggtgaacacatgagaatgtcagaacaccaacggtggggacagtggtggagggagcagcaggaccatacattgtggtagccgttgttggaaggctcttcctcaggttatcactcttgcagggaagatcacaggagattttcattttctgtttgtatttctgtttaagtctgggggtcaaaagagggctcatggtataggtcaactgagatgtgtttgtaagaacaggcttagtctatgtacgagactgtgaaggccatgattagtagagccagtgtgggagcaaagccccacattcacctcctctggttttctcattgagggccaagaggagatagaagccccgagaggggaactgacttgcctgggatccacatggagtagtgacacagagcgagcccaggccttagcacaagaaaggaaaggagtgacttggaagcttttgtttccaacaccataaagaaatgcctgttaatctttagaaaccgctcctgctggaggcatggtaatgcagacagatacttatttatatctgaaaagtagaagcaatgtgtctaggtaataatggggaagctagttaaataaatgtgatagacaacatgaggttttgtcctgccattaaaaatgtttatgaagaattttaaggacatgagaaaatggcaataataaagttaaaaagcagcatattgaactgtatatatagttgtctgatcttcctgacatagtctcattaagggggaaatttagggtggatggtagaattctagagacaatgcacctgccaggttagataggggatgccagcgacacgactgggacagaaggagcctcagagagaggatggggtgagcagatagactgggcattgatctggagacctcaaacaagtgttttcccttcttctaggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggtaaatgtcagcttttaactcttgtgtcagatcctgggtgacattgtggttttaccttctgtatgctgggggcttctgaatgatgctttaaaaaaactaaaatttgcttacattagtattatttttagttataaccataatttgtttagtcagtctcctattggatggttagttaggtttggtttttgccatcctatactagcagtggtttgcaacttctacatacattaaatctggaagagttatagtaattaacactttgtaatagcaaaaactaggaacaacccaattgtacaccaacaggagcatgcataaatacattgtattatattcacacaatggaatattatacatcaatgagaatgaatgaactaaattacacattgatgaaatcttaagccagatacaagagaggacatgctatgtgattccctttgtatatacatcaaagcaaacaaaagtagtttttaggcatatgtgtaccagtgttaaaatgttacagaaagttggctgagcacggtggcttacacgtgtaatcccagcactttgggaggccgaggtgggtgcatcacttgaggccaggagtttgagaccagcctggccaacatggggagaccccgtctctactaaaagtacaaaaattagccgggtgtgtaattccagctactcaggaggctgaggcagaacagttgctcaaacccgggaggtgaaggttgcagtgaaccaggagtgccactgcactccatcctgggcaacagagtgagaccttgtctcaaaaaaaaaaaaaaaaattacagaaagcaaggattctcacctgctcgaatggcaacctaacaatttttacattatcacacacagaattgactttttcaggatgtatagtcctatgaattgtaacacacatatgttttgtttgtttgtttggttggttttgtcgcccaggctggagtatagtggcgcgatctcggctcactgcaacctctgcctcctgggttgaagcgattctcttgcctcagcctcctgagtttagctggagctacaggtgcgcaccagcacacctggctaattgttgtatttttagtagagatggggtttcaccatgttggccaggctggtcttgaactcctgacctcaggtgatccacctgcctcggcctcccaaagtgctaggattacaggcgtgagccaccgcgccttgtttgtttgttttttggagacagagtctcattctgtcacccaggtcactctcactcaacagcaactgatgcaattcttccaaatcccagtacatttcagcatcccattcagttgtaattctgtaaaacaactttcatccctcctgaatagtaactgctaaactgaaggttacttagttgaccgctttcattaaagcaggccttttgtagagtagcccaagttgaaatttttgctgttttttcttgatcattctagatttagttttacctacttcctctcccagaaggttgaagaaaaaagtggttaagaaggtgattaaatctggaagggttcagatgtcttcgaggataaaacaaagaaaataataaaaataaattttaaaaaattaaaaattaaattaaaaaatttctaaaaataaatattcttggaaggagatggtagattttctcacagtgagacttctgttcctaagtattctgttcgtgaatattctggcatagtggcatagataaagcttggatccaggtggcagtagagctggcagaatcggggatggggcctagcagaggctgcagctggcagcttgactcactcagatttggtgttccaaggtggagttcagcttctggtggtttaaggaatttaatgaccttccgtattcatggagattcattttattccatttttttcttttgttagtctacatatgttcttttaatggtaatcacagatattttagtatgtatacataatcaagtcagtcttttgtttttttttttgagatggagtttcactcttgtcacccaggctggagtgcaatggctcaatcttggctcactgcaacctccacctcccgggttcaagcgattctcctgcctcaggctcctgagtagctgggattataggcacacgccaccatgtccggctaatttttgtatttttagtagagacggggtttcaccatgttggccaggctggtctcaaactcctgacctcaggtgatccgcctgcctcagcctcccaaagtgctaggattacacgtatgagccatcacgcccagccataaagtctaaatttaatctttattttcttccagaacattcaaggaactcagaatgcattaacttcattcatccccttcacaatttatgtcctttttttttttgtcaagtatcttagttatatattttaaatgtacaaattaagaagttttactattttatgcaatcagtgtgtgtagattttcccttatagctaccagtatttttgttcatcattccatcttgtgttaaagacctcttccatctgggatagtcgtctcctcttatttaagtacatgtctttaaaaccccctttccttgaagatctcttctttcagttcttgtttgactgcagtgtctttattgctttctcagataggattagaatactaggtttacagttattgtctcttactacattgaagatacaaatcctagctagattgcatcatttcctagctcgcattgctgctattttgaagttggctgtcagtctaattgccgttcctttgaaggtgatcaatctcttttatctggcctctgggtttgtatcatttccctacagtgtttctagggatagatttctatttttacttgagatttgttgggtttcctggatgtgaagttttgtgtctttcaacaactctgaaaaattctcaattagtatctctttgtatagtatcattctctttattatctcctagatatctgactaaatgtatattagacctattatattctccatgtctttttttttcattaaaaaaattgtaaaatacacataacataaaatttaccattttgacttttctttttagtattaaagagatggggtctcactctatcccccaggctggagtgcatgattatagctcactacagccttgacctcctgggctcaagtgatcttcccacttcagcctcccgagtagctagactataggcgtgcgccaccaccattttgaccatttctgagggttcagctgagtagtgctaagaacgtgcaaatcattgtgctcgccataccttttaacatcttatgtttccttctcttaatctctctggctgtattctgggtgatctcttcacatctgccttccagttcacaaactcaccctccagctatgtttagtctgttctttaaccttttcattgaatttgtaatttcagttaactctttttttttcagaagtttatttttttgttgtttattgaaattgctgggacatttttatagtctctcattccttcctgtcttttatttctttaacacattaaaactttaggccaggtgcagtggcttacagctctaatcctagcactttgggaggccaaggtgggcggatcacctgaggtcaggagttccagaccagcctggccaacatggtgaaaccctgtctctactaaaaatacaaaaattagctgggcatggtggctaatgcctgtaatcccagctactccggaggctgaggcaggaaaatctcttgaacccgggaggcggaggttggagcaagtcgagatcacaccactgcgctccagtttgggcaacagagcgagactccatctcaaaaaaaaaaaaaaaaaaaaaaaattccttggcttcctagctctaattttcctcctgtctctgacctcctgttcatttaacaaatcgacccaccacgcccagcttggaaatgttcttattctcagagttgaaagcacagaaaaaataagaatggtcaagaaaaaaataggtgactcatgtccaaagaggctttatttcagtctcatccctgtcattagcagagcatcataaagtaagtaattacattgaaaacacatatttgttggtaatacaaaatagtaatcaacaacagagcaatctaactggaagtctgtatgtcccaagcattttgttttgtttgttttttgagacatagcagtcctttcctgagattcttctctgtgtggttgagcgtagaccaccttgagttgtagcacctgggtgatttccctagggctgccctagcaaagtaccacaggccagatgccttaagacagcaggcattcgttgtcttacagttctggaggctgcaaatctgaaatcaaggtgttggcagggctatgctgtccctgaatcctaggggaggatccttcctttcccctcccagcttcttgtagccacgggtgttctgtgactgtggcagcatcattccagtctctgtctccattgtcccatggccgtcttccttctgtgtctgtgtctaaattttcttcttcttgtaaggacatattggattaaggtcatattggattaaggacacaccctactccagtgtgaccttatcttaactttaattacatctgcaacgaccccattcccaatgacctcatgttctgaggtaccaggggttaggacttcagcatgtattttgagggaacacagttcaatccataataacacacaccttataaacaaagttatcatgcagtatcagggaattacacaattttttaaaaatataagaactctctggtcgggcatggtggctcatgcctgtaatcccagcactttggaaggccaaggcaggtagatcacttgaggtcaggagttcgagaccagcctggccaacatggtgaaaccccgtctctaccaaaaaaaaaaaaaatacaaaaattagccaggcttggtgaccctcgacccagctactcaagaggctgaggcaggagagttgcttgaacctgggaggcggtggttgtagtgagcatagatcgagccactgcactccagcctgggtgacaaagcaagactctgtctcaaaaaaaaaaaaaaaaaagaactttctgctcatctggcagtattttttctagaaatcagatgacatgctggctagaatgattgggtgggggtgggaggcatggaggagggtacagagctggagaggcagagacagtggggaaggatggaaaggtctgagggccatggggcagcatctaagaggatggtgggtatgaatttttagtggcttcgctgcatttttgtggaacttcttggtttgggtggaagatatttctgtataaagagtataaggaaaattgtcctgagacaaagattgttacttgttatgttttttcttatttaagtcattaattttttcttcttgatgagcattatttgagataaataatttgtttttaaaggacaaatcatgctaagactatatcataattcttgacatggtggggtatttgtggcagaaaatagcttctgtccttttttcttatctagacgaggtttgtggaaatgagtccctttcttggggagactctcagtaacttagtgataattgtttatgttacgcctcccagtgctgtgcgtgcctagactgtactgaactatttttggtatgcagcctaataaggttccttgtcacgactgtgtttaaatcacatgaaatactcaaatcatgttcagggttattttttccctgtttatgaaagaactctattttttcttcctactgtgggcacttgaatcttctgtaaatgagttggtcagatgtcctaagacctgtttttcacagcctcacgtcactggcattttggttttggtttcaatcactgtgcagggttttttagcctaatgacctcaacttgatgatgctattggtacttagtaatctaatgtttgtatttttgttcccttttttctttaggattcctggactccagagttaaagttgaagttgataaagtttctagctttaatatctaaagccagcaacacgccaaagcttttaacaatatatgtatccttttgaagcaaatagagaccacctatggttttagagcagattttatttagagttgcacgctggcttaggtttattgaggttgcctcattaaatcgggataattaatagtgttgctttcatatttacaaggtcaatgaatcattaatggcagggcctatagagatcaacttctatatcattggatctctgagactttctttttggcaaggtcttattttgatgtcacgtggctagaagttgtcttggtagaaaagaaagtttaccttcttgtaaaagaattccttgggataattgtccctttgcagaatgtcacttaaccacttttaagcccttcaggccatggcatatggatcgggtgaccatctaacttgtcattcaaattgggacttctttttaaataactttattgaggtgtaaatttacataccataaaatctacccatggtaagtgtacaatttaatgctttttggcaaacgtacagagctgtgcagtatcaccacagtccagttcaaactgggacacttttgaaagtaaaaaggggcactaactggacaaagtaccagggtgacaggtgtaaatagagcctgtttcagaaagagcagaacgttaggtcacccaacccatggaagactaatttcccaaaggttattagtttttaaagacaagtatctccttttacttggaataaaaatgtatccaaagttatttcataacaagaacataatgttttgaatggtaaaattggtcactgtttagtttaatttcatgaaaaatttaggctactttgctgcgtaataccttctgcttcctttctaactccaaagcatttgactttcttgacctaattgaggttttatttgtcactaggactccatgccacatttctacttgagcttcctaagccttccctgttgcctgtattcaaattccttagcctggcctgagccgaacggactgatctacagctctcgtctctgcctttatatccttaaggcttttgtttaaattcttctgtttgcctacataccacgatgtttgcatatccaaaccttttccttcctagagttccatatacagtgattttcagtgaaactagaacttttccaacttgacttataattatttgaatacgctttaaaaaagcatttctcagcttaatttttttttttcttgatactgctccttgtggaacagggctaccccataggcagtgtgcccagagtagctcagcttaataattatgggtgccaatatgttaagaatctaatcaaaatgatttacatggtaaattatattagttatattaaaaatatattagtatactcaaaacagtacctgactgggccccgtggctcacgcctgtaatcccagcactttgggaggctaaggcgggaggatcacttgagcccaggagtttgagcccagagtgggcaacatggcgaaaccccatctctgcaaaaagtacaaaaagttagctgagcatggtagcatccatatgactatagtcccagctatctgggggagacaggtgggcgaatcacctgagcccaggaagttgaggctgcattgagctgtgtattctgccattgaacttcagcctgggcaacatagtgagaccctgtctcaaaaaaataagaataaaaaaagatcatagtacctattttataggaagagtatgaagattgagttaatacatataacttgtatgaaacagtccagtatatagtaagtgcttgataactgttagctgttggcattagaatttttaagtacttgtcacctttcatcctgttccacatgctttgaagcatatgctgaaatatagcaggtaactataaataacattctaatattttccttgttacatgaaaatacttgtagttcagttcaatacattaagcttctactatgagtcaaatattgttctaggatttagggatataaagaaaaggccaagatgtaattctcttagccaaactggagctttgaacaataaaataggagtctgtgaggcaaacagaggagggatgggaattacaggtagagggaacagcctgtgcaaaggcactgagacagtgcctgggaaactgaaataatttaatattactggagcagagtattggcatagacaaactcagagactaggcagggcctaggtcataaaggtttatgccaagtcctataaggaataaggagcctttgaagcattttaagtaagagaataacagttgtatttgcaaaaaataactttttacttcctgattataaaatcaactatattccttatagaaaatttggaaagtacagaaaggtttttaatacagacatacacccaaattgtaataaaggtaggtacatgtatgtgtgtgtatatttctatgcatttttatcaaaggaagagaacatcttcccatatcattaaatagccttcaaaagcaggttaagttccctcagaggtttaaacgtagagttaccacatgacccaggaattggtccaggctgtacacccaagagctatataccctagctatatacccaagagaaatgaaacatacatatgtccacaaaacaacctgtacacaaatgttcatagtaacattattcataatagccaaaaaaatgcaaacaactcaaatgtctatcatcttatgaatggataaacaaactgtggtgttatccaaatgatggaatatcgtttgatatcatccagccataaaaaggaatgaagcactgattcatgctgtaacatgaatgatccttgaaagcattatgctaactgaaagaagccagtggcagggaccaggtattatatgactctattcataaaatgtccaaaagaggcaaatctggagagacagaaagtatattagtggttgccaggggctggggagagcagggaaaatgggagtaactgccagtgaatacagggtttcttttggaggatgatgaaaatgttctaaaattgattgtagtgatggttgcataactctgaaaatactgaaaaccattgaaatgtacacattgattgatgattgattgattgattgagtcagaattttgctcttgtcacccatgctggagtgaaatggcgtgatcttggctcactgcaacctccgcctcccaggttcaagcgattctcctgcctcagcctcccaagtaactgggattacaggcacccactaccaaacctggctgatttttgcatttttagcagagacagggttttgccatgttggccaggctggtctcaaactcctgatctcaggtaatccacccgcctcagcctcccaaattgctgggattacaggcgtgagccaccacactggcctgaaaggtacactttaaataggtgaattatacagtacgtgaataaagctattaccaaaatactaaggaaaagtttaagacaaattaagggaaaagaaacatgttaagtaactgtcttcagtcatgcagccagacgtgtgggaactgagatttgaacccaggcagtctggctccagagtctgtggtcttagcaatactgtgctatgctgttttcacctcaatatcaatttccttaggataaagctttgaattgaagttagagttgaattatgtataaaatcagatttgcatttttagttggcttggtagcagtggggaaggcctttggaaggggataggaaggggataggaggctgttgaaatagtgcaagacttgaattcagacagtgataattgaaatggggagaagaggacttgccttcttctgaaatgggagtgggtcaggccagtatggagaagttgcttagctatttacagcaacagttggagctggccctcccggctccgagaattctgtttcatcatgctgaggtgctttctcacattggccacaggatgtccgataccccaagtaccgttccctgaatgcctgttttcctgaacttctttttcatcccagaaggagaatggacaaagtaacaaaggtaaatcatctagatttaaatttgtctaagaacaactttgccagttcaggtttgaagtagtaagatcggtgcaaagatggagagaattcatgattttggctttaagagtctaaatatttatgaaaggctttgcagtcatagtgacctgcagttccttgaggcccattttcgggagggctggtattgttagcttcgtcttgcatgtcaggtagctaagccttggagaaatgaagagaatccaataacatcccaaagggaggtaactgcagcagcagcacattttccctagaaggtgtagggcagcatgggtaaggatagagttcttttaatttaatttattttaattattttaatatttaacttttaccttgaactagtcaactggggtcttcgaagacatatggagtacccattcttatcaagcattttccattcccaagtaggaattccagtcttcagtttgtagcatgaagtgttatttttccatggtcaattgtttttaccagaactgttcacttttgagtaaggtgagaaaaagtgtagttaatatgaagttggtggccccagttggggcgctgtacctcagttttgcctttgatactacgttttgacagctgcttaaatgatgatgctggaaagggcctgtgatgcatgtcatccctctggtgagtattgatggcataaccctcagttcccagtaggtggagtgtgactacaggagatcttgttccatgcgccagcacatttgccctttcaaagcagagtcatgccagagaggatttcagaactccctgccattgctttttcctgtttctttttagggagtgaaactcttttaaagaaaggaagcattaattagtaaattatttagctgtttgctcaccagggagttggcagataagcaatggggtttgtcaacctcagggagagcttgggtttgggtttgtcactcaagatggctttggcagcgtcagcctttgagaaggcttcggatgcttggttttgctcttggtagcctcaagcatccccagctcagctgttctaagtgtgtgactggttctgccagccatgctgacccttctgtcgctcagaggggacaggccctgctggcccttcatggaggagcagggctacagatacggccccatgggatcaacctggactgctccaagggtcgcaggagcaccctgagtcttggagctccccaaggttgccctacccccagtacagtatgtggaggaagactcccagcctgcatcctcagctctgcaggcccgctctctcagtgctagcctaggcccaggcctggccacggtgcgtcccgggccagtttgctcacatccaacacagctggcatcttcaactggactgggactttggatcttgccctgcagctcctggaaatacacctcagcccactgttccattgctgcctgacagaccatcccgacttggtggcacaaaacaatgacattcacttataatggtgatgatgagcctgcatggtctgggagctgtgggctcagttaagctgttctccctcagcgtgtctctcaggtgcagtcaggcggagcggcctggggccaactccaaggcactcacacgcagagtggtggtcggtgctggctgtcacgtggggtctcagcagaggcccttgacgagaacacctgcgtggccttgtggtctgggcttcctccaggcatgttgcctggtttccaagggtgaatgtccccagagagagccaggaggaagctgtatcactttttctaacctagcctctgaagtcagtcagtcatttctgctgcattctgtttcttgcaagtgaattcctaaggccccctcaccttcagagaaaggaaattacattcctcttcttgatgggaaggagggtgtgtcaaagactacaggcattttaaaaccaccaccataccctgcatctctggaccctagagaactgccttagttgttagttgaatctgccaggtcgctgttctgaactagcctttggacccccaggcaatgggggcaggaaggtggtgagaaacttctctctctggttcctgagtttctgcagctcatgtccccctagcatacactgcatttttgagcatagctttcttctgggagcattatgtaaatctgataagtggcccagttttgcagatcaaataaacatgggaaggggaatgcaaataaaagaattgtctttctctacaggtttttaatgttggaatttcagtaaggagaccagtttttaagccttctttagggtcaattttaactgagttttctggaagccaagcagaatggctgtggatttgagtctggcaagcaaagtgcatctgtggcggagtgaactctgtaatgtggtgttgctatggagattggagattcgcattttgggcccaggcatgacagtcatttgtcacccccttgtcccctcatcctgcagctaaggctgtaataaccaaaggcacagacatgcccccagtttaatttaattctagactcaggcattgttttaagtgaagtggttgcatgatatcattgttctgtgtatcttgataggaagttttcacggttaagtgagattaccagaagcttttaaagaagacaggaaaggcacttgcagcagaaacttctctcagaaggaattacgtttgaaatgctgtgtggaataaaaacaggttgacaatgtagtaacatcggattattattttcacctagtcacttaaaaaggatatagaaatagtatcttttggcatttctagcatgaattgattcaaccctttcagaatgagcagttgatcatttttctggagtttggagccctaaacagtattttaaaaagtaatgactcatattcataagttacattataactttcttcatccagtatctgtggattagcaaagtagcaaggaggtaatttttatctgaatacaaacaggaaagagtatatcattataaagacagagaggttaattttagcttttcatagtgggtgagaaaaacaattccatatttaaaagttgatcattttgtcttgagcagccaattaaaatctcatttaccctttaaaaaaaagtacagtgccctaagtgaagtagaaaagttaaaaaagaaagcttgagtggcgggggagagatttacatcactgttatgtcagtaattttggatatgaagagtctcaataaatttcactggcatgactaagatggttttattaaaataacatggaggttataataagacatctccattaaaagttgaggtcttgtcactaggcgtggtggctcatgcccgtaatcccagcactgtgggaggctgaagtgggaggatagcttgaggccaggagtttgtgaccagcctggccaacatagtgagaccctattgctataaaaactaaaaaaaattaaccgagcgtggcgacgtacatctgaagtcccagctactcaggaggctgagatggaaggatggtttgagcccaggagttgcagcgagctatgatcgcaccactgcactagtctaggtggcaaagccagactccgtctcaaaaaaaaaaagaagaggaaattgaggtcttgcatggcaaggcatcttggtttagttgttcttgtctcataaaacttttgacagggaaaatagaaagtcctgtttaatgctctgaaataaagctgatgtgtttgagctatcacccacgtagcttctagtcatggacaggtcttgtttgtagctagttaaggtatctgcaaggtgatgtctctgggtagcagcctctcctcctaaggagtatacagttgtccctcagtatctacaaggattgcttccaggacccccacagataactaaaatcaacagatgctcaagtcctttatgtaaaatggcatggtgtttgcatacaacctacacacatcttcccatatacattaagtcatctctggattacctatacctaatacagtgtaaatggtgtgtatactgttgttataccattttgtttacgacatgaaaatgatatgaaaaaaagtctgtatgtgttcagtacaggtgcttcttttcccgaatattttcaacctgaggtggttgaatccacaggtgcagtacccatggatatggagtgctgactgtatttgaaaatggtcacaaacatttcagccctattgcctgcttctctctttccaataggctgcaggcagttaggccttttatcccggagatgtgccacactttgaaattgtcataaattctgattctgggttcccaaggcaaaagttccacagataatctcttatgtttagtaaattgcagaatgaacttccggggggaagggttcctttgtgcagtccggagggactgctttggggacattcacattggtgacttgggaggtcattgagcctagctaatgggttttggtacttgattcatcatgtaccacttggtccgtgttgagaaagtttgcatagatgttctccaatacttacgactgcaatatgggattatgaatagtattctgtagaattttcatctttgaaagttttaacttatctaattttgaactctctatatatatatgaaaaactttatttgtattcatttatttttttgagacagcgctgttgcccaggctggagtgccgtggcatgatcttggctcactgcaacctctgcctcctgggttcatgcgattctagtgcctcggccacctgagtagctgggattacaggcgcatgccaccatgcccagctaatttttgtacttttagtagagacgggatttcaccacgttggccaggctggtctcgaactcctggcttcaagcaattcaatcgccttggcttcccaaagtgctgggattatagatgtgagccaccatgccccacctgaaaaaaaaattttttttttttgagatgaagtctggctttgtcgcccagcatggagtgcagtggcgtgatcttggctcactgcaacctcctgctcccgggttcaagcaattgtcctgcctcagcctcccaagtagctgggattacaagagtgcgccaccatgccctgctaatttttgtatgtttagtagagacggggtttccccgtgttggccaggcttgtgtcgaactcccgacctcaggtgatctgcctgccttggcctcccaaaatgctgggattacaggcgtgagccactgttcccggctgaaaaactgtaataatagcacgaatttaacacattcctttttttttttttttttttgagacggagtcttgctctgtcaccaggctggagtgcagtggtgcaatctcggctcactacaacctccacctccctggttcaagcgattctgctgcctcagcctcctgagtagctgggactacaggtgtgcgccaccacgcccggctaatttttgtattttttgtagagatggggtttcactatgttggccagggtggtcttgatctcttgacctcgtgatccacccgcctcggcctcccaaagtgctgggattacaggagtgagccactgcacctggccaaatttatcacattctaagaggcagaaggtagtgaccccctttccctaatgtttaaggagaatcttgataaatgattttcagggccattctcaggggagtcaagtactggatgtaaattcatgccaggtgactttttttttttttgagacggagtttcgctcttgttgccctggctggagtacaatggcatgatctcagctcactgcaacctccacctcccaggttcaagcgattctcctgtgtcagcctcccaagtagctgggattacaagcatgcaccaccacacctggctaattttatatttttagtggagatggagtttcaccatgttggccagactggtcttgaactgctgacctcaggtgatccacctgccttggcctcccaaagtgttgggattacaggtatgagccactgcgcccggcctttgccaggtgactttttaaagttatctttcaaaactgagatttgtggatgttgaataataataataattcattatcattgatattttgggtttttaattatttatttatttatttttgagacagagtctcactctgtcacccaggctggagtgcagtggcgtgatctcagctcactgtaacctccacctcctgggttcaagcgattctcctgcctcagcctactgagtagctgggactacaggtgcgtgcctccacgcctggctagtttttgtatttttagtagagacggggtttcaccatgttggccaggctggtctcgaactcctggtctcaggtgatccacccgccttagcctcccaaagtgctgggattacaggcgtgagccaccgcacccagctgaagatattttgggttttaatagtaaaaatattttacttctgtatataaacagtaatcaaacatgaaggtttttgaaatacaatttgaatgtaggtttttagaacacaaattaggaagaatggttaacttaggttatctcaaacctgtggtgtgcaccagatccatttgaggagtttgttgactatatagacattcagaccccactcagtgtctataaaatcagaatctctgggagtgaggcctgatcatctttatttgtgggtgattctgatgtatttcagagcttgcatgccactgctttaggatggaacctttctgccacttttaaaagttatctacttgtggccgggtgcggtggctcacacctgtaatcccagcactttggggggccgaggcaggtggatcacctgaggtcgggagttcaagaccagcctgaccaacatgaagaaaccccgtctgtactaaaaatacaaaattagccgggcatggtggcacatgcctgtaatcccagctactcgggaagctgagtcaggggaatcgcttgaacccgggaggcggaggttgcagtgagccgagatcacgccattgcactccagcctgggcaacaagagcaaaactccatctcaaaaaaaaaaaaagttatccacttatatagaaatgtatttacaaagtctttcacccctttccatgaaatgaaatagtagtaatagccaccactatataaccttctctaggtcagccattgtgctaggcatgttgagtgtctttttttaaatttaatcttcacaataacccatcaaagcaattattgtctccattttataggttaggaaatgagaattacagagttaaatattttatctgtggttacccagcaaaaaggtaatagagtagggatttgagcccaggtctttataattttaaaatatctctccatatccttgaaacctgttctacaatgaagacttcaaatattgtacagtacttggatcaggacaatagtgagttactctgggtttgggggcactgttacctcctttcgtccaaagtgtgactttcaagaaagagggaaggtggtatgggcaaagaagtgccaacaccgatgaggatttgcctattcctgccgagaccagggtggcttggcttcagtgtctttagggctgcccacggggggattccaagcaaagaatcctagagccttctaagctgcttgctgtaaggcctggtgggagtggttttatgctttatcaaactggcagaatgatggaatctcttctccttctggattcttgtttttcctagcaggagtcaagcagcccaaagttttatttaaaataaagaagtgtcctgcagatatgaattgtcccccagacaacttcataatacaaaaacagagaaaaagacacaggtttgattcaggcattttatgagctcagtatagaataaaacattctttttttttgagacagagtctcactctgttgcccagttgcccaggctggaggacagtggcgcgatcttggctcactgcaactgctgcctcccaggttcaagcgattcttgtgcctcagcctcctgagtagctgggattataggcgagcaccaccatgcctggcaaatttttgtatttttttagtagagatgggattttaccatgttgcccaggctggtctccaactcctggcctcaagtgatctgcccgcctcggcctcccaaagtgttgggattacaggcgtgagccaccaccagccctagacatgtttattttcttagacctagaagaactaaaagaaattgcatgaggttcagtcaagggaatagattttcttaggaagcccagtgaggattgggttgaacttcctgaaaaggaaattttaagtcagtgtggttacaaagcactatgtaaataaatgtggcataaaatagaagtaagtgtgaaacacaagtagtgtccagtttattgttacaagaaaacattctggcaataagtatggtagttctttgagaagaatacaattatttttcatattgtggatttttattgatgttgtttgttttaactgtcttcctagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatggtaaggaagatccctaattgtgtgtatgtctgtttggcaatgaagaaggcttataggcatggactatgttgatatggcaggtggagcctgcctctctccattccaagccagtggcgcctgctgctctatttccaaaagccaacatgcatgaaggagataaagctgatattttttactgtttttatcaagctgcttgcagtgttttacccatttttcttaacatactgtctgccatatctttatttctctactttattcttttttgtttgtttgtttttgagatggagttttgctcttgttgcccaggttggagtgcaatggcgtgatctcggctcactgcaacctccgcctcccagattcaagtgattctcctgcctcagcctcccgagtagctgggattacaggcatgtgccaccacacccagttaattttgcatttttagtagagacagggtttctccatgttggtcaggctggtctcgaactcctgacctcaggtgatccgccagccttggcctcccaaagtgctggtattacaaatgtgagccactgcgcctggccctttttaaaaaatatatttttcaaatattgagacggggtcttgctttgttgcccaggctgattttgaacacctgggctcaagtgatcctcccaccttggcgtcccaaagtcctggggattacaggtgtgagccatcacacccagcctctaccttattaatattagcaaaggataaattgtctggcaacagaaaaatatgtgctagcaaaaaaatgaggggcacgtgccctgctgtcatatagggaagccactgattttctaatattggttttgtatccagctacctttctgaatcccattaatcttgggttttttgatttattcttctgtgttctagattgacagtcatgttacatcaaataatatttgtgttttgcttttaaaatttatcttaacttttttttcttagtacattggctatggcctatgggatagtgttgaataatgtcatcatgggcatctttatctcattcctgactctataaagtacaataaaatctatttgtggacatacagattttttaaaaattgaagtaactgtagattcacactgcagttataaaaaataattcaggccaggcacagtggctcacgcctgtaatcccagcactttggaaggctaaggcgggaggatcacttgaggccagaagtttgaaactactctgggcaatatggtgagacctctgtcactaaaaatatacaattaaaaataaaattagccaggcatggtgtctcacacctgtaatctcagcactttgggaggctgaggtgggcagatcatctgaggtcaggagttcaagaccagagccccggccaacatggcgaaaccccgtctctactaaaaatacagaaatttgccaggtgtagtggaggacatctgtaatcccagctactcgggaggctgaggcgggaggaactcttgaacccggctggcagaggttgcagtgagccaagattgtactccagcctgggcaacagcgtgaaactgtgtctcaaataaataaatttaatttaatttaaaaaaagatgggtcagaggaggaaagctggactctttactagcctttctaatgtaaaagaaccgcgttgttttggtaaaagattgaaacagttcagagaagcgtgtagtaaggagcaaaagctccttcaccacaatgctgtagattcatttccttattgatgttcaagactgacattgtcttgtgtattattttagaacatttctctgcgtatgcgtgtgtgtgtgtgtgtgtgtgtgtgtgtgtgtacacacatgcgtacagcatttgtacccttagttgggatcatatgatgcattactcttctgaaacttggtatttctctttcgatatatcttggagatctttccatatgaccagatccacctcattctttttaattcttatacacaattgcattataagggtgaatcattatcagatctctggtgatgaacatttagattttttgtttttttgtttgctataacaaaaaaatgttgcagtgaacatccttgtgaatactgtacatcttgataaaattctaaaagtggaattgctagggcaaaggtatgggcatgagcattttgatagaggttgctaaattattcgtcctaaaatatcaacaatgtctactcccccagtagtgtatgagagtgcctatttctccacacacggcaacaccaaataggactaaactttgaaatctttgtcagtttggtaagtaaaacttggcattctgcatattttaatttagatttctttaattatgtatgaggctgagtatattttcatgtattgttcttggctatatgtatatatatatatatatatatatatatattttttttttttttttttttttttttttttttttggtcagtcatccattttctttcctcattctcctgttttaagcaagaaagtgacatgatcagattggcttgttagagaaatggttctgctagcagtttcagaagttaaaggaggaaacagtttcagaactgagggtttgatccaaagtctcaaaagccacagaaaactccagaagaagagacctgaaaagtatccagtgtttttgacacttagaagctcactggttgtgagctttgccacacgagtttccatggaggaacgcaggtggaaagttggtcacattgtattgaaagttgaaggtgggttgagacagtaaatgcaagcggttctttcaaggaccttggctgtaaagagaagctgttgagagggtgattgatagataaggatctagggtgaaaaagaagaagaagaaaatctagggtagaagacgggaaaggtatgtttttaatatgaaatatatgtgaacatgtttctagttgtagggaaggaataagtatagaaagaaaggttaaaaatacaagatgaaaaaggtatgtttttttgttcgtttgtttgagacagggtctcactctgttgtctagctggagtgcagtggtgcaatctcagctcactgcagcctcggcctcccaggctcaagccatcctttcacctcagccttctgagtagctaggactacaggtgtgtgccaccatgcctggctaatttttattttatttttattagagatggtatttcactatgttacccaggcaagtctcaaactcctgagctcaagtgatccgcctgcctcagtctcccaaagtgctgggattacaggcatgagccactatgccaggcctgaaaaatgaatgttgaaattttaatactatagaaatttactataggaattcagaaggaatggactcaggataatataggaggtctagccctgggatggggttcctttttctctgagtcacttcacatgtagctatgtaacaaagggtgacagacctctgccacaggatggacagagccttttatgtggctgaagcagaccagaagtttgtagcagataggcaggaggcccaggaggagagaaaagggcccagccctttccagctccccaggggtggagtagccctgcttcccacgcagtcctgggggatggccttcctcccatgcaagtggatgagcaaggggtgggagagcagccgcttctactgccatatggaagttcccccaggtggaatcatgaagctgcggaagaggagactattttcaattatcatgcctagaaaaaagtgtggaagggtgtacactttttaatagtcattatccgcagggattggtttgtgggggaagggtgggattcaggagaggttgtggtacttgtacattgaaatgagcatacattatttttttaaaaagaaaatagatgaaaaaaactccaagatgaccactttcgatgttgtatgtcaatcctgaattctcgtagctggtgagagaggcacaagagatgctaaaggagaatgcaggatccagcagcgttgatggcgacagcagctcagccgcacgttgtcgagcactggatagttgattaaaagcgtttccatcactcattcagcaagcactggccaagccacctgtcatgtgctaggcatatctgtgacctcatttacctgctcactgtggctgttacaataaaggtgtggaaagcgagaggcagagctgttggtcttctcgagtccaggacttgagccctgatcttcagttctgaagcttggctctctttcccccacattatggttgtccagtgactttgttacatgaatttaccaaagtggtttaggatctgtttattctacatgacagtggagatagctgaagtggagtcagttaatttgcagtctgatgtctcatgagcacacctgcagtgtgttagcaccttgttctgtcagggccggtactttcactcctcccaagagctctgatgttaaagcaaatgattatttttctggcttacatacctcatcatcatgccttacagaaagctgttgagagaccactctaacaattgccagcgtgcctcaggtgtccctcagtgagtttcatgccatcaccagatgtctttgtatcctccttgcagatcacccctgagtacctccagagcgtctgtgtccgcctgttcagtaaccagatgcggcagagcctggcgcatagtgtggacttcacgaggcctgggacggtgaggctctgcgctcagggcagggtgcccgtggtctatccccccaaatttaaaaagaatgtaactttaaaaatagcatgaaaaaataacatgcaagaggctgcatttaagctggcttttgaagtctagaaactcctagaaggaaaataaatctgtttttgaagagggtacagctgaaagctggcctcctagggagggtgaggagagaggcgtgttctgcctaccagttgcagccactcagtgggggttcccagggttggggatcagtaggagtggatggaaactttattctccttttttaaaagcactgccatagtggaaattgtgtggtctaaagcagggacactttttttccccctaactttttacttggaataattgcaaaactgcaaaagtagcacaaaggacattggtatacccttcacccagagtcacccgctgctagcattggccccttcctttgttgtgtctctacacacaagtgaacacgcacacatatgcacaaaatctgttttctgaactatttgaggataaattatatatattatgactctttactcctaaatacttcagtgtgtatttcttaaggttaggaatattctctcatataactatacagttaccaacttcagtaaatttaacattgatacagccttcttatctaccgtccattttccaattttggtagttgagtcaataatgtccttcactgcatttcccgtcctctggtcatctagggtcaattgtcacattgagttggcacagctcttagcctcttctaatcttgaacatttcctcagcctttctttgagttacatgacattaacatgttagaagaatataattttccccctttaaaaaaaatagaacattttgctgggtgcggtggctcacacctgtaatattccagcactttgggaggccaaggcgggtggatcacgaggtcaggagttccagaccagcctggccaacatggtgaaaccccatctctactaaacatacaaaaattagccaagcgtggtggtgggcacctgtagtcccagctacttgggaggctgaggcaggagaatcgcttgaacccgggaggcagaggttgcagtgagctgagattgtgccattgcactccagcctgggggacaagagcaagacttagtctcaaaaaaaaaaaaaaaaaatagaacatttctccttttgtgtttgatatttccttataattagattcgggttatgcatccctgaatcacctaggccaaatacgacgtcggtgatcgtgtgtcctccttagactagcacacctgaaggcccatggttttgaggcaggcattcttaaccaggagagacactgttgtctctcaaagtcttcaaagtacaggaacccacgggccaggagctcacaccaacctgctgccccattcacaggctgcgtgggtgaagccctgtgaagccagctgtatagatttggaatgaggctcctgtgtgatcctgagacagccctgtgggtcagagccacagcttttaagtgagggtttgcacattaatatagtattagagtcttaataaacagaagcctttcttttagtatttaaaagaaaatttataccctacctaattctcaagtagatttgaagaagtttattataatatgagaaaacataaatatgagaaacgagaaggtagaaaataaaaataagtaaagcagttgtggttaagggaaaataagggtggaaaaaataaaagtcagcaagggctaaggctggtacaaaaaatgcatatgctgtgagctgcctctccggagaggcaggctgcagactgggctctgagctttccagcagtctgtgcaaaaagggaaacaggagcagttacatgattcccagtgcttataaagcaggagagggcagttacataacttttattatgtaatatttcctgcatccaaaacaacatatgtgctgcatatgcaggctaggaaccatgacaataaaacaaacacccacaagtccgccacatgtggctgaaatagaccatttcagtgctgctaaagttttctacccttcaggcttcttccaagtaggtgtgttacttatgtaatttaaaaacaagttcaaatgcttttttttttttttttaaactggatggtcagacaactgcttcacacagttattcctggtgctaagacccgggataatctcttgggtcagcagtttgtatggatcttcatagaaggcacgtagtcatgtgctgaagagcaggcggccttgaccacttcctctcagcctaacaaatatctcagaatggctggctgtcagctgttccacacacgtggacagacagatggtagaagcggagtctttgggacatggccacagtgattttagtgtgccaaaatcttagagaatcagccatttttaaaaggtcagtaaagtcaccattggatatgcaagtcttagaaaagtaacttcctcatgagcccctcagaagaaggacttgaagccacatccccgagaatatggctgaccctctgtccactgtccagttaacattcggacagttaggaagcagagtgtgcttaccaaaactgtggctttctcatagcaattagcatgacagggtctgtctactaggagcactcctttcttcctccttcccatttatttgttaattcatcaaagacttagtgttttctaggttcagtttataaaatcccattatatcttatatataccagccatccttacattcccatcttctataggaggagtgatgtatccagtttatttaaaactgatgttggtcaggcatggtggcgcacacctgtaatcccaacactggtagtccaaggcaggcagattgcttgagcccaggagttcgaggccagtctgggcaacatggtgaaaacccatctccacaaaaaatacaaaaattaggccaggcgtggtggctcacgcctgtaatcccagcactttgggaggccgaggcgggcagatgacaaggtcaggagatcgagaccatcctggctaacatggtgaaaccctgtctctactaaaaatacaaaaaaattagctgggcatggttgcgggcacctgtagtcccagctacttgggaggctgaggcagaagaatggcatgaacccgggaggcggagcttgcagtgagctgagatcacgccactgcactccagcctgggtgacagagcaagactccgtctcaaaaaaaaaaaaaaaaattagttgggcttggtggtgcgtggctgtagccccagctactcaggagcctgaggtgggaggatcacttgagcccaggaggttgaggctacagcaagaggagatcgcaccactgcactccagcctgggtgacagagtgagagcctgtctcaaaagaaagaaaaaactgatgacatgttattaagcacggtttaaaaaggagcaggggtacaacacagctggttatcccacaagaagttatcaataccatctgtcaggagacagtcctaccaccccgactgttatgttagcagcaaaatacagactttgtctaaccactggaaaccagaggagggaggatgagttatgtttagcttagtgataaccattctccttctactgaatcattggcttaggaacacgcaataaaagctgcaaaagccttttactgtttctagccgatttctttaacaagatgataaaaagcgtatggggggtcattgtcaaagtataagagagtattgttgttgactagacatgcatatataaagttgatttatgatatgtgtctcgagttcagatttacaatgtgtgaagaaggaaattaagaaacagtttagatgcaatgtccagtgactggactgataggatttaggatttggaaggagaagaagattgcttgcttttttgctgatttttttaaagggataaattctactctagggcccaacagaaggccatcaatttcaaaataagtacgtggcacagatcagcgtccttcatagagcggtcttgggtcagctcgccgtcaggtgctctgttgagcttgagtgttactgctaattacattctgtaaaggagcttgggctgggccctttcacaaaaccgttgatgtctataaagtttggtacacttgatactggtttttatatctggcagttaacaagaatctgggcttctaccaacttactcactgttaaaaattcaaaagggcccattaaatcgagcccttctttccccctgagttctgaactggttgaaaaataggacaaaagagtaaaggaaaaaggagctgaaaatatcactgttggtactgacaaagcttatattggagaatgtggatcttttttttttttttttttttgagacagggtctcgctctgttacccaggctggagtgcattggcacgatcagggcctctgctgccttgacctcctgggatcaagtggtcctcccacctcagcttcctgaatagctgggactatgggcctgcaccaccatgcccagctaatttttattttttatttttgtagagatgaggtctcactatgttgcccaggctggtctcaaactcctgggctcaagcagtcctcccactttggcctcccaaaatgctgggattacaggtgtgagccaccacacctggctgagaatgtggattttgtttgcaggcaggtggggtcctactcttgtgcctgggaattacggaagcattcttgcacagccctggacagctctggccaagcctagcccgctgccattgctgtggccaccatgagggcggcatggaggagcggagttgacacgtcttctctggtgggctctgcccaaagcagaagaggacaggcagggcagtgatgcccaggtctgcccccagcctcacaagtcctgttagtcaccgcctctctggagaggaagtctcccactgacagagcagctcacggtagaaacaccacaagaggaaagaagtgaggttctgccctcacctagttcacacccaggtagctgtgttcagaaagctgcccgtgttatcgaagctggcacaggtgtctaggcactcccagagggtttataaggacggtattcatttctttgaggcgagagctgtcccaggtggcctttttagtttgactccgcgtattgctgctcccacccatttgtctttctgtagtccttaccttatcagagcctgtggcttgctgggatatgggagaaatcagattttatattatcatcaacttagtgataagaagtaagggagaaagttatccctcagggcacaagaggctgagttttttgttttctaagattacgcaagtcacgcgggtgtgttcgtttgcagggaacgcagtgctaggctgttcctggatgacagtctgctgtcggggtttcacccatggcagagcagctccctggctgtgatctattgaaagtcagccctgggcagaaggggttagtgttagggttagggctagcgttacacaaatatgttagctagaaagtataccattttatctgtaaatgaaggaaaacccatcccctcccttcgctcagcgcatcctgccctcccgtgggaacctgttgcctgtgtttcatatgcgtccttctagagccttgaagtatatatcattaacttttacttgtgtgtatattttctttatcttctagagttctaatttgagaacggcattcctctatcagacatttaggtggcttttctgttttctgctgtttgtaatggtgtagtatgcattttccctgccaagagcagttgaaagtgccttggttggtctttctcttcttcaccccctgttccccctgggcaaatgtgaatgcagagacactggagaaaaggtatgccacgagagggggctgttccacccacaccaagcctgttccacccacaccaagcctctgccctaagagcaggagtgggtagaaggcaggctgaccaggagacagaatctggtgccaactcctaaggtagaaattcgagctcctgccccctggatgagtcccaagtctgacctagtggcacctctgggtttctggattccttggatggggaggtttccatttaaatgcatccttatttagaaagatgcccatttgagaattaatgctctttttcttcaacaactccagataaggccccattggaaataaaagtcaaaacactttatttatttggcttttattttaggctcagcaggtacatgtgcaggtttgttacatgagtaaattacatgtcactgggatttggcatacagatgatctcatcacccaggtagtgagcataatcctgagagttagtttttcaaaccttgcccctcctaccctcccccgccaatagttcccagtatctgttattctgatctttgtgtccttgagtgctcagtgtttagcttccacttagaagtaagagcgtgtggtgttaggttttcttttcctgtgttaatttgcttaggatgatggcctccagctgcatccatgttgctacaaaggacatgcttttgttcttttttatggtttcgtagtattccattgtatatgtgtaccacattttccttatccagttcactgctgatgggcacccggattgattccatgtctttgctattgtgaatagtgctgccatgaacatatgagtacgtgtgtctttttggtagaacgatttattttcctttcagtatagaattgctgggtcaaatggtagttctgtttgaagttcttgagaaacctccaaactgcttttcacagtggctaatttacattcccacgaacacatacagagctttttttgtttttgtttttgagacaaggccttgctttgtcgcccaggctcactgcagcttcgacctcctgggctcaggtgctcctcccacctcagtctcccaagcagctgggactacagatacatgtcaccacacttggctaatttttttttttttttaagaccgagtctcgctccatcaccaggctggagtgcagtggcacggtcttggctcactgccagctccgcctcccgggttcatgccattctcctgcctcagcctcccgagtagctgggactacaggctcccgccaccatgccctgctaattttttgtatttttagtagagacgaggtttcaccgtgttagccaggatggtctcgatctcttgacctcgtgatccacctgcctcggcctcccaaagtgctgggattataagcgtgagccaacatgcccaaccttttgattttaatttgcattaaaatggttttgattttgtgatagagactatagcattaaatgtaaaaagacccaggacatgtggctcttataaggcacctgcttccacctcagccatctttgtcagcagcttcctgctatgtggcttgtggctctggcttgaagctcagcatcttcagcccttgccttctccccagtgtgattttcttacatcttggcaaatgcctacgctttccccacattgctgccatgtgtccaggccatcttccttggtgcaatgccctgtgtattgaggagtctcccaaccagcacccctgaccctgctatacctcgtataccaatgcctgttgcatacccagaccaacctggtgatgagagggtttaacacctttgtaggccgggtgcagtggctcacgcctgtaatcccagcactttgggaggccgaggcaggcagattacttgaggtcaggagtttgagaccagcctggccagcatgacaaaaccccgtctctactaaaaatacaaaaattagccgagcgtggtggcacacacctgtaatcccagctacttgggagactgaggcacgagaatcacttgaacctgggaggcagaggttgcagtgaactgagatcacgccattgcactccagcctgggcaacagagcaagactctgtctcaaaaaataaagcacctttgtattaatatctcaaccagtgagttagagctgtgaccagccatcagctgagacctttctcgagctccaaacccagacttctggcctccccatgaatgcctgacagcttcaccagatttgtgtccaaatcgggctcaacttttcctccacacaggtggtctcccctcctgaatttcctgtctcagtgaaagacactccagggaacacctgggaagcgtctgaggtttttctctgtcctttgcctggtaatgggatctgcaagagcttcctccctccctgcccacattgctgttgtttttgtgtttgttcaggctctccatagttccctcttggcttaatgtcacatttcctaactggtcttaaagctcttaccttactgattatttgtcacatgggatctgaagtggcctttctggttgtgtcttgtttatttgtacccttcatgttccaggaaggactcaggtgtcttacaggcatccgatcatattactatcttgctcaacaccgttatcaccttagggtgaagtggttttcatctcttttaacgtgcaagtgccccttctcgttaaaaagctggcagggccggacgtggtggcttacacgtgtaatcccagcctttgggaggccgaggcgggcggatcatgaggtcaggagttcgagaccagcctgaccaacatggtgaaaccccgtctctactaaaaatacaaaaattagccaggcgtggtggcgcacacctataatcctagctactcaggaggctgaggcagaagaatcgcttgaacccgggaggcggaggttgcagttagccgagatcatgctgctgcattccagcctgggcaacagaacgaggttctgtctcaaaaaaaaaaaaaaaaaaaaaaaaaaagctggccatagcagccccttccgcatctgatggggatgtgcctctggcttgggcctccatcgcctgcccagtcccctggctgagatattgcctcaagggttccattgtgggcatttgaacctctgttgagttcaaggggccctacattccttacccacgtgcatcctgcacagcctgcccagccacagtgctctgttagtccaggtgagtagggagagaagaaggggttggcagaaatggcctcatcttcaggggctcactggtagcctctcctggggtctggcccccaaacttactttctgcccctcactggcccgcgcacccctgccccatcctgctgctgtctctacttagagcagcgttttccaaagcctgtgcccgcaaatgcccatcccgcaggatttccctgccccacagccaaacagcctgggagttaataagcttgtgaactgccatccagtgagattcccagcacagcagtacacaggagactcccgagaagtcccgcgggagaactgctacccctgctgagtccagtcagtctccagttagatcggacccaggaacactttccttaccttacacctcctgctggtttgtcttagaaagtccccatcctgctagtcaccaagagctgtcccaggcttggtgtggccccactgcccacctccccacatcctgacaccagctagggagagcagctgctctgggaggcaggccccaggtcttcctggggctgagaagggatggatgggggcagaaatgcagctgtttcagcttggcttaggtaggcatttatttttcctacccaaaggttccagagaacctagaagggagcctggcacggggcaagtgctcagtgaataattgatgggttactacattagttgttccactgttcttcacctgcatcctaaaaagggttgcgcctgcatttgacccagacatcttcagatgggagcataccacccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccgcccacccgtgcacacctccacgggagggagaccaccacgtgcatttgcaggtccactgtgattgggagcacagtcctttttctgatgccccaggcctgccaggcctttccctgagctctcagcctgaaatcctagaaatgagacagcactcacttgggctggagtgggctggagtcagagcctccgtagcaggtggagtccaccccgtgttcagaacccattgttagctcagtgagggaaatttttctgactggtgattggtgattctgactgtgttggatggtttggggcttgtgattgttgatgtctttgttgtagggctgtctgttgcactgtaggttggttagcagcattcttggccgtcctccattagatgccagtagcactactcccgctattaacaacccaaaatgtctccagacattgccacatatcccctatgggcaaaaccactcccagctgagaagcactagagggaaaggaaacatggctagtgcacagtgtggaaaatgctgccactcacactgcagagaacgcaggggatgctgaggaaaatcagtgccggcccatgctcccagaggggagggtagacggtgatgctggaaatggtccctgagagcatggaaggccagggaagatcggagctatcttggaggatggggggtgaaggaggccgaagagagtgaggggctgccagggagaggagctggtgactaaagccttgcgggggcctgggttgaggctgagcagatgcgatttttacaaagacccctgtgttgagtgtggaaggagggctggaggagagacctgaagcaggggagtgggcagagcaaatgtggactttgggacccgactgcctgattagattcttgttctaggggaagttgctcagtccctgtgtttgctgatctgaaagtggaaatggcagtgcatgaaatgagttaatatgtgtaaagttcctacagtggcatgcctggtgactagtgagccctcagtaaatgtcagtgagtacatccttattaagctaaggtggtagttcagaggagagaagaagtcctgaatggagcccctggcatggggattggagagaaggtagcagctgtgggatggaatcagtaggacctgatactttgggagatgtagagagtgaagaggccacttttttcttttctttttctgtttcttttcctttttttttgagatggagtctggctctgtcacccaggctggagtgcagtggtgcaatcttggctcactgcaacctccgcctcccggattcaagcgattctcctgcctcggcctcccaagtagctgggactacaggtgcccgccaccacacctggctaatttttgtatttttagtagagatggggtttcaccatattcgccaggctagtctcaaacacctgaccttgtgattcacctgcctcagcctcccaaagtgctgggatgacagatgtgagccactgcacccggcctggccactcttaactaatttaattccttaacaatcctgtgaggtaggtactgctggtgccaccattatgcagatgaggaaactgaggcgtggggagttattcggtcatttatcctcctcattggattgtgagtgctctgagaagggcatttgctttcttcactgcgtatcactagcgcatagcagagacctggctgatgggggcagtcagtaggtatgctttgcttgccaaatgcatgaaatactgcagccttctctccttattttattatttttttttgagacagggtcttgctctgtcaccaaggctgcaccgcagtggtacaatcatagctcactgcagcctcaacctcctgggctcaggtgatccttccacctcagcctcccgagtagctgggactacaggtgtgcaccaccacacctggctaatttttactttttgttgagatgagtctcactgtgttgcctggctggccttctctcattgagagcatgctgagccactccttctacagccatctccagctttgtttattttattagatactaaagttgtaataatgtttatcagactggctgtactcatgaaagggccaattattactgcttttcaaccagtttcttcacagggcaaatagaatgatagagagtttagcaaaagagtgttttaaaaggtagaaaacgttttttggctacggaaaaaggagaatgttgataaatttcatttgtggaaataaccagccaatatcactaattatcaagtatttttctttatatattatggtaatattttatttatttttgagacagagctttgctcttgtcacccaggctggaatgcaatggcacgatctcggctcactgcaacctctgcctcactgattcaagcaattctccttccgcagcctcccaagtagctgggattacaggcgcccgccaccatgcccagctaatttttgtacttttagtggagacggggtttcaccatgttggtcaggctggtctcgaactcctgacctcaagtgatccacccacctcggcctcccaaagtactgggattacaggcatgagccaccgctcccagccatgctaatattttagtatggccatgtccttacttgacccgtctgacttgttatcttagcttcttggtctctgtaaggtgttaggtgaataatttttttcttttttgatacagggtctcactctgttgcccaggctggagtgcaatggtgtgatcttagctcactgcagcctcaacctcccaggctcaagcaatcctcccacctcagcctcttgagtagctgggaccacaggcacgtgccatcacaaccccctaatttttttttttttttttgtagagatagggtttcatcatgttgctctggctggtctcaaactcctgggctcaagtgatcctcctgcctcagcctcccaaagtgttgggagtacaggcgtgaacggctatgcccagctagatgaataatttagatgacatttcaaacttattttctaaactcactatttaagccaacaacaggaataggtaatttctttattaaaacaatcaagggttaaaaagtataaaaacatacatgcatggtctgagccacttttttaattttagtttttattttcattgttttttgtttttgtttttgtttttgtttttgtgttttgagatggagtcttggtctgtcacccaggctggagtgcagtggtgtgatcgcagctcagtctcctgtgttcaagcgattctcctgcctcagcctcctgagtagctgggactacaggtttgtgccaccacgcccagctaattttttgtatttttagtagagatggagtgtcaccatgttggccaggctggtcttgaactcctgacctcaagtgatttgcctgcctcggcctcccaaagtgctgggtttacaggccggggccactgtgcctggctgatctgagccatgtaaaagtggtgtttggctgggcgcggtttggctgggttgaacccagtaggcggaggttgcagtgagctgaggtcatgccactgtactccagcctgggagacagagtgagactgtgtctcaaaaaaaagaaaaaaaaatgttatggaccagagttgggcttctccaagtttattgtgcaggcatgtccgctggggacctggctgaagtgcaggttctggttcaggaagtctgggatgggacccaaaattctgcatttccaatgagagctggatgatgctgcttgtctgaggagcacactttgagtagcagggggctgcagagtccagaaacaaacctaaggatagatgtatacctagcagacaacagaggtaggaaaggggtggtttatttcatgggtcacggagtcagatgctgtcagggctaggaagtgtgtaaagcagctggtgtcaggctgtagggagctctggggcctgaagatgatgttccttccaccttagtgttcacattctaatttaaaaaggaagaacaaaaaggaggtgaagaaaaagatagggaggaagcaagacttactgatggaagcattttgaggtgatgttggatggcctgggtgggacttacatgacgcagcacagctggctctcggggaacaacaaaacaaagttgcatgcctcattcacaccacagaggaaaatacagtagcatgaattccagaaggatgaaatctctaaatgtaaaaaataaagctatgaaaatgttagaagaattgagagaatgtgtgtatcatcttgaggtagggtagaccttcttaagcaagactgaaatccatgaaaacaatctggtatcacataaggcatgaaggcaaagtcaaaaagcaggtaatgtctatgaaaaataatggccaatatcactaaagtttaagaaagtaaactcttttctacccttcgaattgatggaagttttagagtgataggctccagtactgataacgaaaaaggaaagctttccttcagtgcggggtgtctggcaatgtttatcagaattgaaaatcacataccctttgatctagattttggaagtctagcttagctcataaaacaaaatatcagtaagtacaagcatggtggcgcacacccgtaatcccagctactctggaggctgaggcaggaggattgcttgagcccaggagttcaagaccagtctgggcaatatagtgagaccctatctataaaaaaaaaaaaaattgaaaaaaattgaaaaaaattgaaaaaaatttaagtatcattaactgacaataagatttttaacaaggcttctgtaatttcatgcacacaggggagaatcataaaatggatccccaagtgcccatcacccagcttcagcaataaatggcatttcactaatcttgcttgctttcttctcctctacttattccctgcccccaccctggagttctttaaaagccaattccaaacatgtcatgtcacctgtaaatcattcaatatacatttctaactgatcagaggctttaatatacaagcacatagccacaacaccaaatacagttaacactaattccttagtatctaataccagtccactccatattcaagattttccttattttctcaaaatatctttttacagttggtttatttgagtcagttcaaacaagcactacacactgtatctgcttatatgtttctcagatgtattttagtacataatacagcactacctgtagtggcaaaaagaaacacacacacacacacacacacacacacacacacacacacaaaataaatgggacaagaatctccgtaaagtaggtgatgattttgcctatggacaggatcaggattaaaagagagtggggtggaagaggggttgttaatgttttttaaacacgtgtagaaaatgtttgacttggtacaaagtgcacatttttatacttgaagagaaaatcttaataaagaaaaaaaccagaataatataatgattcatattgcttttgttcttcacaatgtatttaactaggcagtttgaaatgcccctgggagtttggtcagggagaacccatcgttttccatagaggatttttttttgtttggttgtttttgttttttttctaaagaaaataaaggaatcaaagaatggttactccgtaggcagagcagcctctagagtttttcttggagtggtgtaacatcaaaccagggctgggtaggctgtgagctggattagtggtgtgtaactttagtttgggttgatttttacatcgtatgtgactttggttggtgaatcctggtggattaaaactttgcacatctgggccaggcgcagtggctcacgcctgtaatcccaacactttgggaggccgaggtgggcggatcacgaggtcaggagattgagaccatcctggctaacacggtgaaaccccgtttctactaaaaatactaaacaaaattagctgagcatggtggcaggtgcctgtaatcccagctactcaggaggctgaggcaggagaatggcgtgaacccggtaggcggaggttgcggtgagccaagattgcgccactgctctccagcctgggtgacagagcaagactcagtctcaaaaaaaacaaaaacaaaaaaaccgcctctccgccagaccgccgccgcgccgccatcatggacaccagccgtgtgcagcctatcaagctggccagggtcaccaaggtcctgggcaggaccggctctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttgcttgctcgctgggtcttggatgtcgggttcgaccacttggccgatgggaatggtctgtcacagtctgctcctttttttttgtccgccacacggaattgagatgctcctttaaataaagcgtttgtgtttcaagttaaaaaaaaaaaccaaaaaaaaaaacccaaaaaacctaacttgcacatctgttgattccatgctattagggtgatttgggatccgtgcattgctatcagtgtttaacaccatctgttttcttctgtcctcttccccccaggcatccaccatgttacgagcctccttggcacccgtgtaagtaactgctcttaggaatttttattaaggagaacagcaatgtgtaaaacgggaattcaaagtgtctttaataaacacttagcagcctaggttagaggaatgcctttgagctagagctacatgtgaatattaaaggaaatacgagtacttataagtaatgttgttaaactagaattattttttattgcctgtgtggtttttttgtttgtttgtttttttgagacagagtttcgctcttgttgcccaggctggagtacagtggtgcaatctcagctcaccagaacctccgcctcctgggttcaagcgattgtcctgcctcagtctcccgattacaggcatacgccaccacgcccggctaattttgtatttttaataaagacgggttttctccatgttggtcaggctggtcttgaacacccaaccgcaagtgatccaccccctttggcctcccagagtgctgggaatataggcgtgagccaccgcgcctggccatcttatattgttaattctattcttttggtaaggaagcctcaaacaaaaaaacctgttgaattgttcatatggtattgtatagaagtgaatctaatctgctatcatagtgcaatccacagagtgttgcactgtctgaatttatgttgtctgctggttcacactgtgatcaaggccatgggcagccctgtgtatgcctgagcactcctgtcctgatgagttgggctgtcccccttacgagtgtctgatgctgtggtggcaaggaagttgagaacctttgacttgggcatgaggaccagggtggcttctgggaccctctgagccagctttgcgggagaggaggggaagacgggtgctgtgtgattcctcacacacctgagatgcccacagccttcctcctccctcagccctgcctgagtctgaccttgaccccacgctttattctctcctaccactttggcagcagtatcactgcacagactgctagggttaaaagcccacccctgctaccctccctgtgactggggattacttgtttaatttctctgtgcctcagtttcctcacttacaaaatgaggagaatcatagtaattctattataggattattgtgaggatcaaaattagttaatacgtatacaacacttagcatttggcataatactgtagtattacaccaaaattaggaaactatcattgatacagtactgtgaactagactgcaaacctcatttagtctcaccagtttttctatgccctctaatcttttctacaataaaacaacaataaaacaaaacgtgaagacgcttgttttagcgacaaggaagctgaggtgattccttttgtttctggctgaccgaaggtgggtggcagggcagtctgagctgtgtggatctccaatccaaggtctctcctcactgaaacctggctccccagaggtctttggagtctccctgaggagggtctgcaaattgtcctacaacccatctcctgcctatgttcccatgctgcttcctgaccacaccttctacctccttggagggctaagccacccacctaattactctttttttcttttttttcttttctttgagacggagtcttgctgtgtcttgcctagaccggagtggtgcgatctcggctcactgcagcctctgcctcctgggttcaagcgattctcctgtctcagcctcccgagtagctgggactacaggcgcgtgtcactatgcccggctaattttgtgtttttagtagagacggggtttcaccatgttggccaggctggtctcgaactcctgaccttaggtgatccacccgcacaggcctcccaaagtgctgggattacaggcctgagccaccacgcccggcccccgactgcttactcttcacacttgtttcctgactgttgttcatattcccccggtccagtagctcaggcttgagaggaacagtggcttcaggtgtttaggtagaactcttggggcctgctgatgctaattttctttgaattatgtccaaaattctaaacagaacttcagtggaaagtcatgatgccctcaaggtgatttcttccctatgctagggaggtctggctgaaggtgaatgtaggggtttctaaatctgttcaggcaaagactccttgttttaggaaaaatgttaaacagaacctaagtccatccaacagaataggcagagctgagctggttgaagctgaggtaggagcctagaacccagcccgccctccaagtggaagccgggaggtcatgctgggagcccatgggaacagcaggctctagcttgggtgtcataatgctcaggaggtgtaataaacatgcccttttgcccttttctttctctttgaacttgtgttgctgagtaggaaattgaaggatgtcccattactgccctccttggattatgagaaactgaagaaggatttgattttggggagtgaccgcttgaaagccttcttgttgcaggctctgcgctgggtaggtacctttgtcttaaagttagaaaacaaaaccaaaccagtgctggttttcttggctggctaccttgcttatatcttttaacccatcttccagaaatctttcttccccgctgtctgctgacaccaagaacggaagtcaaaagccacttctgaagatagcctgggcctccttttagaaactcctatattatggcaattgtgatgtaatgagttagataaatgaatttcaaggcccaagagactgcacctgtgtgtagccctttcctggtgatgagccccactctgcttgtgtgagtgcgtggagtcagggttacccacagtcccacagaggttctgtattcagccactgccatgcagccacgctggacaggcaccaacgaaagaactcctgttcacagggcctaaggaaagtgtcctggtccccatcgctacttttctgcctggtcttcagactgagtgcagttgaagtcaacaactggttctcaagctttttcgtgtcagaccctttccactctcaacaatgactgaggacctcagagagctttcatttacgtgaattctacctgccaatatttacagcatttgaaattaaaactgagaggatttggctgggcatggtggctcatgcctgtaatcccagcacactggcaggccgaggcaggtggatcacctgaggtcaggagttcaagaccatcctggccaacatggcaaaaccccatctctactaaaaatacaaaaaaaattagccaggcatgagggcaggcgcctgtagtcccagctactcaggagactgaggcaggagaattgcttgaacctgggaggcagaggttgcagtgagccaagatcacaccactgcactccagcctcggtgacagagtgagaccccatctcaaacaaaacaaaacaaaaccctgaagatttgaaatatatgtttattaattcatttaaaatgagcaataataaatgacatgttaacataaataacatttttgcgacaaatactactttccaaacaacaataaaattgtgagaagagcagcattgttctgcagttgtctttaatgtctggcttgatggaagacagctggattctcatatctgctttgtgtttgattgtcagtgtcacacttcatatagcctcccagagattgatcataaaaaaggcattgtcacatcttagtattatgaaaattgtgaccttgcagacctgctaaagggtttgggggacctcttagggttccctggaccacactgagaactgctgactcaagccaacagtggttgagccagcagttctttaactgaacagtccattctaattcattagcatcagacaccttcatggacacccaaatttcaaggtgtcttggcatcaggatccttagcaatttcccatctgtggatagaaacagttctcacttgcatgcttctatggtagtgcttcctgaagtacgtcttgaggactcggacgacgtatccaggatccacaggaagagtcctgtggacaagcagtggtgtctgctctggttttgtttgggtcaggactagagtgggtggggcagcatgagtcatccacggtggccgtttcctccctggccattgcctctctctgctcaagctctcaaactcatcttttatgcggctcttggtttactgacgctgcacttcctctcagtccgtgctactcctgagcctcttgctgagacagggtattcctttgctgagagggtgacatcttcacagaataaccaggaaaagtgaacaggtttctaatgtttttgtctgtgtccccctccagtgcccccacccggctttttgcccctgcttcaacctcagtgaactcaacggaagggtagcagcaccccagtgtgacattccaggcacaccctggccatggtcatcacatctgttggcagtgcctgctctggaggcctccccggctctccttccagcccagggcgtctgatgctctggcctgcgctcttgcccacgctaagaactagcatattccttgcacatctagcttctctttggctagaagcagggcttgcagcctcaggatttttatctagtaggattttcctgaaaaagcaaggatatttgctcactctgttacatgctttttcatatcccacctcacacctgtacacaccgatgtgcacacgcacatacccgttatacatgctctccacacgaaaattttcttctagccctgtggacattgcgtaaatttttacttgtagcaacatgacagacttatggctttctaaaatctacaaaattctagccagctacctctacactcatgcatgcacgcacacacacgtgcacacaagcgcacatgcactgtatcactctgtcattcccaataggataggatagagtgaatttgttggcagggcatgcattcagagtgctctacagtcagccctgggcccctcccactgagcccactccactgtgccctgtattatactttcctgagctagacctcacttccctatcccccactgtgctcatgctcccctgtgctggttaataggctgcccatcctgcagggaccagctcctgagcccctttatataagaaatgcttctctgggcatggatgagctcttccctatctgcacacttacagtctgagcattttgctgcctcacttctctggagagttcacatgtataagttggctccctgtgtcacccattaggacatcacaggttctttttttttttttgagaccgagtcttgctctgtcgcccaggctggagtgcagtggcgcgatctcggctcactgcaacctccgactcctgggttcacgccattctcctgcctcagcctcccgagtagctgggtctacaggcgcccgcaccacacccggctaatttttttgtatttttagtagagacagggtttcaccatgttagccaggatggtcttgatctcttgacctcgtgatccacctgcctcggcctcccaaattgctgggattacaggtgtgagccaccgtgcccggcccgcatcataggttctcgttttggttggctggttaacttgccaccactccccaagctggatattacttattttgtttggttaaatgtgtaggtactgatactgccatctaaaacacacctgctatgagaaacttttctccatgataagacttaggtctcactacttttgtttttctttgctccagcgcttgaccacatcccatcctggagagcagagggagaccgttctgcaagcctacatcagcaatgacctcttggactgttatagccacaaccaggttggtaagaggtggggccagatcccagccagggccttcaattctagggaatgatcttagcagatgggggaagcttataatttctctgcacattttcagcttcgtaactgtatgtcagccttgagctcatgaggttctgggcattggcttactttttgcttctagtgaagagttctaaacaagttagaactgcctgattcatcatctctggagctcttttctgccgtttttccttttctcaaattccctactctttacctcacctcactgcttaccatgagtcctgaaaactgagtatgacttcagagggacaaggtaggtaagcaaattcaggttgtttacatctgggcctgactaaaaatttctttaacacagtactttacttatagttttgggccagataggtctactgatcctgtgggaaaagtatgagacttggggtaaaataaactggctttcaaacctctgctctaccactcattagccaggtcaccgtaagcaagttactcagtctcaggcacctcctcatctgggcaaggagccgcgcctgcctcgggaggtcgttgggatgattacatacagtcaggtgggggaagtccttaagccccaggcctggtaccaagtagtcactacatggtctttctcttctgtccttgcccctcctacctgtatctgcaccaaacttcactggacaggaggaggatcaggattttgaatttggcacgtgttaagagtgtactacattttattatttcagttgaatttttatccagagtgctgtaaaaatgtaaagctattgttaaacttcacaacgtgtgcactgagtggagtatcaaatgctctggacactcaccgattaaacagctgtcttaggccatttcctgctgctgtaacagaataccacagatagggtaatttataaacaatccaagggtattgtgctcatagttctggagtctaggaagtccaagagcatggcgccagcatctggcaagagtcatcccaaagcaaaaggcagaaggcagaagtgagcgtgcaagtcagagaatgggggtcgaagctgtctttttatcaggagcctactcgcacaataactaacccactccggcaataatggcattaatccattaatgcctaatatcctcttaaaggtcccacctccctgtactactacattggcaattaaatgtcgatatgagttttggtggggacattgaaaccatagcaacagaccgtgggaaagtgagttacacattcatctgttgtgcatacaggcaatacaatctgagttttgagttgccagtttactctgtgaatgtagtcttaatgttctcatgaatgagttaagtttgaaaatagtctctcatattcttgacttattttcttgcttttttttcctgtttggatttataatggcattgaatccagcctacaaggcatgaagcagctgaataatgtattgttataacttccaaactcaaattaaagagtaaagtcaatactgattatttctaacattatttcattgagtcgaagatacactttttccccccattttaacatctttgctattagggtgtatctgacagtcaatggcattttacagtttaattggcaggggtttttttctttcttgattatgtataaaatgaaaatgtgtcctctgatgaaaggtgtgttgggttttgtcatctgtgatttttgtcaaaaaggcagtgacctctatagccattgaagagagtaatttcttcctcaagtcattatatgtagttgctatggtttacttatatatattttttgagatggagtctctcttgtcgcccaggttggagtgcagtggtgcaatctcagctcactgcaacctctacctcctgggttcaagcaattctcctgcctcagcctcccaagtagctgggattacaggcgcccgccaccacacccagctaatttttttatttttagtagagacgggatttcactgtgttggccaggctagtctcgaactcctgacctcaaatgatccacctacctcagcctcccaaagtgctgggattacaggcgtgagccactgtgcccagctgtggtttatttatttatttattcatttatttattttgagatggggtttcactctagtcgcccaggctggagtgcagtggcacgatctcggctcactgcgacctccacctcctgggttcgagcgattctcttgcttcagcctcccaagtagctgggattacaggcatgcgccatcacgcccagctaattttgtatttttagtagagatgggatttctccatgttggtcaggctggtctcgaactcctgacctcgggtgatccgcccgcctcagcctcccgaagtgctgggattacaggcctgagccactgtgcccagcctggtttatttttttaagaagaaatgagctgctgggcacagtggctcatgcctataattgcagcactttggtaggccgaggcgggtggatcaggaggttaggagatcaagaccagcctggccaacatggtgaaaccctgtctctgctaaaaaattagccagacgtggtggcacgcacctgtaatcccagctacccaggaggctgaggcaggagaatcgcttgaacccgggagacggaggttgcagtgagcagagatggcaccactgcattctagcctggcgacagagtgagactgcgtctcaaaaaaaaaaaagaagaagaaatgagctgaacgcttgaacccttttacactgctggtggcaatgtaaattagtacaaccactatggaaaacagtacggagattccttaaagaactcaatgtagaactaccatttggtccaacagtcccactagtggccatccacccaaaggaaaagaagtcattatatgaaaaagacacatgcacacacacgttttcagtttgcagttacaaagatttggaaccaacctaagtgcccatcaaccaaagagtggataaagaaaatgtaatatatatacaacatgagataccactcagccataaaaaggaatgaaataatgtcttttgctgcaatttggatggagctggaggccttattctaagtggggtaactcaggaatggaaaatcaaatatcatatgttctcacttgtaagtaggagctaagatatgaggatgcaaacaaaaattttataatggaccttgcacaggtgacagtgttcactgtatccactgggtgcactgaagtctcagaagtcaccactaaataacttatccctgtaattaagaaccacctataacccagaaacttgaaataaaactttttttctaaaaaaaaaaaagaagaaataggccaggtgtggtggttcatgcctgtaatcccagcactttgggaggcctgaggtgggcagatcacttgaggtcaggtgtttgagaccagcctggccaacatggtgaaaccctgtctctactaaagatgcaaaaattagccatgtatggtggtgtgcacctgtaatcccagctacttgggaagctgagtgcttgaacccgggagactggggttgcagtaagctgagattgcgccactggactctagcctgggcagcagactgagacgccatctaaaaaaaaaaaaaaaaagaagaaatgagttgaagttctcttaagatgtcagagaatctgcagggcagaaagactccttgtccaacatggatgctgtgtcactatggcaccaaggtaaactgacctgtacagacaggaaattgaattcgttggttcattcctctcccatagtggttctcaaagtttaacatgcatcgttatctcctggaggtctcattaaaacagatcactgggtcccaccaacagtttccattcaataggtctatggtggggcccaaggatttgcatttccaacaagttttccagtgatgctaatactgctggtccaggatgcgttgagaattacagcttgagaccaaaaacttgaatggagccaaatttaatgaaattgtagagaactgaatttttcatttttagctgaattcttagtttctagacttcataaatatctctcttcatatctctaagcatcttacccatttttaggtgtacagttcagtggtattaaacacattcataatgtgcaaccatcatgtgccatccatctccataaataacttttttcatctagtaaaactgaaactctgtacccattaagcaataattctccatttccccctactccaggcccctggcaaattcccattctactatctgtctctatgattgtgactactccaaatacctcatataagtagaattgtacagtatttttctttttgtgactggcttatttcacttagctaatgtcctcaggttcatccacgtagcatatgtcagaatttctttcctttttaaggctaacatttcatcatatgggtggaccatattttgcgtatctatctcttcctccgtcagtagaagctactgtggatagtgctgctgtgaagtgtgcatgcacatcctgactgttgtgttaatccgctccttgcttttctttatagttttcccatctatgtatatcccgcataatacagtgtttgcttttgtgctgagtagcaagcatcagccttgctctgcaaggaaacaggactgtgcccatgttagatgaagttagctaggagaagatggcataaaccaaagtttgggatgacagttagacatagcctccctgagcacttattgatcccctctggggacattggtaatcaaaagtgggagagagtcctgggaaacacagagcgtctggcggaattgaaaggtgggccaggtaccagttgtccaacagcaatatttattttttttttaattttttgagacagtctcgctctgtcacccaggctggggtgcagtggcgtgatctcggctcacttcaacctccgtctcctgggttcaagcagttctcccgcctcagcctcctgagtggctgggactacaggtgcgcgtcaccatgcccagctaattgttgtatttttattggagatggggtttcgccatgttggccaggctggtctcaaactcctgacctcaggtaatccgcctgcctcagcctcccaaagtgctgggattacaggtgtgaaccactgcacccggcccggcagcaatatttatgcctaagggcaatggtgagctgctgtgtattttggctttacgctcacttgatctacttctagttctcaggggttgatcacttgagaacacttctgtgggagtaaaaaactgttcgcagctaatccacacagcagggcatggaagggggagctagaacttcactagcactgtttagggttatccaaatgcagataagagtctgggctcgtttcaccagtcattttgtgctctgtttaaaaattgggacctcgtgcactactttggaacacgggcagcgtttactaaaactgaataccttatgtcctagcaaaaccactcctagataagccccaaccaaaacgtgcccatatgttcactaaaaaacatgcaagaatattcatagctgcagttctagaaccaaaacactggctgcaacccaaatgtccatcagcagtagaatgaatacctgtgatgtatttgtaaaatgggataccttgagcaatgagaaggaacacagcagagaccctgggtgaatatcacagacatattgttgaatgaaaaagtcaaacataagagaatatataatatatggtttcatttattaaaaaatttaaggaggagccaagtaacatgaatctatgatgttagaagccaggagagaagtcacccttggtttggaatggggttctggaagggcatctgggactatggtcatgttctgtttctttatctggttactagttagccacatgttcgctttgtgaacactcatcaggctgtacatgtgatctgtgcaatgccctgtgtagatgctatacttcagcaaaaaatcaacctaaatgggtgtaatggtaataggcatcttggggacgacagcctttgacatgttgccctcttgaattagctgggtttagtctggaaaacattctggtgcatagctgctgtccaggagtctcttcaccaaacttttattgattcctttcacctctctcctgaattggatctctgtttccagtgtcccatattatcttatttcttgacttgttctctcggttggtggaacacatcctttagttaataacgtctagagaaaaagtacacaggaagtaaatttttttgagatcatgtatggtcaagaaatgtcttcattcttcgtatagaatcctggattgtaaataattttccttcagaattttgaagacattgctccattgtcttttaggttccagttttgctgtacagaaatccaaagccagctgggcacagtggctcatgcccataattctagcactttgggaggccaaggcaggaggatcgcttgagcccaggagtttgtgagcagcctgagcaacatagaccccattctctaagaaaaaaaaaaattcttttaaattaaccaggcatgttggcgtgcacctgtagtcccagctaactcagaaggctgaggcgagaggattgcttgagcccaagaggttgaggctgtgagctgtgatcacaccactgcacttcatcctgggcaacaaagtgagagcttgactcaaaaaatttaaaaaaagaaatccaaagccattccaattctttatcttttgtatgtgacctgtgtttctctccctagaagcatattgaatcttcccaatttcccattgacgtccttcatgaggtatattttaatcccttttattgagcactttgtgggccctttcagtctgacaactttcattctggtcttgagttattttgttgatggtttcttccctctgttttctgtgttctctctctgaatgttgaacctcctgaactggttttctattatagttttctctcatcttttctactttttgttccactctttaggagatttcttttcttcttctttttttttttttttttttttgagacagtctcactctgctgccctggcatgatctcagctcactgcagcctctgcctcctgggttcaagcaatcctcctgcctcagcctcccgagtagctgggattacaggtgtgtgccaccacgcctggctaatttttgtatttttgtagagacggggtttcaccatgttggccaggctggtctcaaacccctgacctctctgcccaccttggcctcccaaagtcctgggattataggcatgagccaccctgcccagcctccctagcagatgtcttcatctttattttctgacccttctgttgacacttttatttcctttttgatagcattctcttgtttcatggatataatacagtttcttatatctttgaggatattattgatgaatttttatttaatttttagttttcttctccctgcacggtctcatttactccaagccccgcccccaccctccccccctatttgttttggcctcctggtagaaacttttctcagatgtctgctagtccttggtgatctcctaatgagagatttggagtgaaggggaccacaaagccattgagtgtgatggtggggcctgtcgatggatagttccacccagggggatctgggtgggccgtttgctgggaacctctgatttcacggtctctaattctttccccgtgggctggtcatttcactgtgagaatagtcttctaatctcaggcctagagggcaaaggtctggttgccagggtcctgggagccaagttttggggtggccctctgttccacattcattctgcatttagacactaacccccctctccattttgttctagaaccccggcaagccttgctctcctctgcctggtgtcccagatccacagaccctttgtgtctccctcacaagggaacaccctctccccagccctgtgctgagaggtgtgcaggagtcacatgagtgggatccaagtgcttcttgaacaactttaattcattcgtctttatttttcttcagctcttaagtgctttgaggagtgagtaatggaaattgggtaattccacagtgcccgttgctgccttgagatttggccttcttgagcctgctaagcctcttgccatgctgcagtcccacttccagaattgtggcgttatcgtttctcgtgctgttctctctgtccttgggaattatcttttttaacagtccatttattgtagttttactgtggcttagagggagccaaattagtcatgtgtcttggatctgccattctaacctggaaaacagccgcaacggtaacagcaaacaggactgcttccctcgcgccagtcactgttctgagggcttcgtgtaattaattcatttaatttggaagtctgactaacttatttttgccaagtctcatcaaatttcagttggaaaacaaggattccagatgaaatgtttggctttagtctgtttatttcacctctaataaattcaggcagaggaagagaactaccagacccgaagaggaggcgtgtgtttatctctccgtgttcttaaccttgtttttcctcttgacgttttcccccagaggagtgtgcttcagttgctgcactccacgagcgacgtggtgcggcagtacatggccaggctcatcaatgcttttgcgtcactggcagaaggtgagacatcagctttgcttcaaagataagagctaggtcatattgatgtgctttttcctttgaaaatgagcgttcctcccaagtttcttagagatgacgcttcctcagtttgttaccgtttaattcatctaaggtcttttgtgaaaattaattgttgtcatattgctttagtttatatcagagcacatttggacagtttttggggtttattttgtaaacctcccggttttattttataaagctttctggttttgtaacatagtaacattttatattgctttcaagtatatcacaggtaatgaatgcatcttctataattttctacttaaggcaaaataagtgaaacaattacggcaaaataagcttagcgaaacaaagcagactccaataaacactgcaccatttccttcagaagactatgacctcttaaatcaaaggatttgaaaactctgaaaataacatgcccccataactgaatttaaaatgattttgcaaagtgccattatcttccgtaagttcttatttatttgagctctttataatgtgaataaagggagttttcaaattatgaatatatgatactccaaaactttgttcatttgttcattcgttcttccatccatttggcagacatttatgataagccaggatgtgttactgaggaccattcatataataatactgttgaaacttatgtctgaaattaacatcttccatatccattcagaagtccacaacaggctagggaccattctgggcttattacagggtcccaggtgtggcttcctgcttcttctccaggccttgtacagagagtgtgtatggaagcattccttggctgcctctgttgtgaagacttaagggctcataacacacacattacccctcatttctctttgtagatctgactgttgggttcaggatttcatggaaaaaaaaggacaatgctccccacaagaacacagcaatgaattatgtttagctcacaagaagagtggtttttctagtcaccagatatttcattgaataaaaccaacgtttaacgtttagaagaaatatcttttaataagttttaataagttttgtgggggttttgtgtgtgtgtgtgtgtttggtttttttttttttttttttttttgagagagtctcactttgtcaaccagactggagtacagtggcatgatctcggctcactgtagcctcaaccacctgggctcaaggaatactcctcgcgcctcagccccccaattagcgggatcaacaggtgtgcatcatcatacctggctaatgttccttagtttttatagagatgaggttacgccctgttgcccaggctggtctccaacgcctcggctcaaacagtctacctgcctcagcctcccaaagtgctagggttacaggcgtgagccaccttgcacaaccagtaagtgtttgtttgtttgtttgtttgtttgtttgttttgagatggagtctcgctccgtcattcaggctagagtgtggtggcacgatctcaggctcactgcaacctgcctcctggggtctagcaattctcctgcctcagcctcccgagtagctgggattacaggcatctgccaccacacccagctaatttttgtatttttaatagagacggggtttcaccatgttggccaggctggtctcaaactcctggcctcaggtgatctgcctgccttggcttcccaaactgctaggattacaggcgtgagccaccgcgccctgcccagtaagttttttagaacataaaattacccaaactctactgtgttatatgcaaagtaagttttcgtggaaagtggttttgtagcataccagataaattatttctgtctttcacctgtttcatctctggtgtattatcaggtcgcctctaccttgcccagaacacaaaggtgctgcagatgctggagggaaggctgaaggaggaggacaaggatatcatcaccagggagaatgttcttggggccctgcagaagttcagtctcaggtaacgactgtgcaataggtcacggtgtctcctgtgagatcagattgagttaaaattcccatggcaacccaggaggcagatggtatttttccactacactttggagaggttggatgactttctaagacagagctagaaagcttatctgtaatccactaaactatcctgcgcaaggctgctggggatggaggaagacattttcaaagcatcattggattttcctaatggacattatcgagtgccagccatgcaggattgtgtctcagggcatgtgcagggcttagagacagacacatgaatcagacctgatagagcctcagccctcaagttacttccagtcccctgtgggagctgcacacatgaatgcacatcccagcagagtgtcaagggcagttctgtggaagtcagggttagggcctcctgaccttgtccatgatcccagcagcccaccccatgggatcagcctagaccgtcatgacttggaaccaatggggccaggctaatttctgtatttctagtagagacaggattttaccatgttggccagtctggtctcgaactcctgacctcaggtgatccgcccacctcagccccccaaagtgctggaattacaggcgtgagtcaccgcacccggccccgtaggttcctttttagtttacagttttgttgagatgtatttacacaccataatattcccccatattaagcatacaattgaaggatttttagtgtatttacagagttgtgcagtcatcaccacaatccaggtttagcacatttccatcaccacaaaaagaaacctcatacccatttacagtcactcctcattcctacccccagtccccggtagccacaaatctgctttctgtcgattgacttgtactggacgtttcatataaatggaatcatgtagtgtgcactcttttgtgactggcttctctcacttagcatcgcgtttgcaaggtttgtccatgtagcagcatgtgtcagggcctcattccttttgtggctgaatatgtactccattatggctacatcatattgtttgtttgtttttgagatggagtctcactctgtcacccagactggagtgcagtggcgcaatcttggctcactgcaacctccgcctcccgggttcaaccaattctcctgcctcaaactcctgggtagctgggattacaggcgcacaccaccacacccggctaatttttgtatttttagtagagatggggtttcaccatgctggtgagtctggtctcgaactcctaaccttgtgatccacccgcctcggcctcccaaagtgctgggattacaggtgtgagccaccgcgcccggcctacaccacattttgtttgtccttcagttgattggcatttgagttgtttgcatttttggccaatatgcataatgctgccatgaatgcttcagcacaagtcttcgtgtggacatatgtttctttttctcgtggatcggcatctaggagaggaactgttgggacatatggtaattttttcagagtttttattctctcatgatcacctcaagttctctttgactttcttgagaactctagtccctggagtcttcaacttttttctgtcggtcctcttctgaacacactttcttcccatcaaatgtggtttacatttgactgactcacaaataaccagaagcctacaaagtgaaatggtctaagcatgtgtgtttttagtgggggaagggataggtatttgtatctaccatttgccagctccctgccaatgaaaattctttgttctaactatatgaatcgaaaagaactgtaagtgctgcagagtcattacttcctcagagcatacaaacacttcatttctttttgtttatagagagaactttgctccatgttgatcgctttggggaagtttttagaaattcaataactatagttaagtaacagatacaagatatggtgaaaaaaatacttcctcctggtaatgcaaatgtttactgcctgtttatcttttcctctaagtgttaatttaagcttttttgttctgtaaatgtgcttaacctttttgcagttttccagagtctctgcaataaatgaagaaggtagctagttaccaagagagcgcagtcttcactgtattctaataagccaccctgattgggtcagtgtagtgtttaagaacaggatgaacggataactggttctgctgttctgtcctgagtggtggtttcaccataacctgcgcatccggagatgtgcagagctggcttctctgtggcatgtcagttttctactaatccagatggcatctcataatgataccacacttagtctcagcaattcttaaagctaacctgatgacattcaccatcacacattttgatggggtattggattttgtaagattctacacctggactttgggtggaaaatcattccttataatttgcattaaccaggtcattaaactacccttactctatagaaatgtgaatcaaagtgatgttaagctaggcttttgctcctccttgttttctttatttttatacagctcagagtgcctagagctggattatagagcgtttaggtaaaaatctatttgtcagctgggcacggtggctcacgcctgtaatcccagcactttggaaggttgaggcaggcagatcagctgaggttgggagttcgagaccagcctggccaacatgaagaaaccctagctctactaaaaatacaaaattagctgggtgtggtggcgcatgcctgtaatcccagctacttgggaggctgaggcaagagaatcacttgaacccaggaggcggaggttgcggtgagccgagatcgtgccattgcactccagcctgggcaataagagcaaaactccgtctcaggaaaaaaaaacaaaaaacctatttgtcaaagaagtatttctatggtcctgtttcctgggttaagtaaaccaaaagctacaaataaatatttattagatatttgaagcaatgctctgctaattttaaatattgaaaaggaaactttcaaagtaggaggcctccttaccaccttatctttatttaaacccttaataaatatccctgaaatgtaaagaatttttgttatttcaattgtatgggtttaacaaaaatattcctcagagtctatgtcttctgtaagtttgtcttttctgatatgcattcacattactgtttcttcttttttttttttttgagacagagtcttgctccatcgcccaggctggagtgcagtggtacgatctcggctcactgcaacctctgcctcccgggttcaagcaattctcgtgcctcagcctcccaagtagctgggattacaggcgccgtcaccacgcctggctaatttttgtatttttagtagagacggggtttcaccatgttggccaggcttgtctccaactcctgacctcaggtgatccgtccgccttggcctcccaaagtgctgggattacaggcatgagccactgcttccagcctactgtttcctcttatatgaaaagtttcttggcagtttgtatttaccgtaggctctttcttcccaggcgcccgctgcagacagcgatgattcaagacggcctcatcttctggctggttgatgttctgaaggaccctgactgcctgtctgactacacgctggagtactcggtggctttgctcatgaacctctgcctccgcagcacaggtctcagccccgaccctcattctagtgcaagaaggggaagagatcttgactcttgaagctgggtttctagtgagcctgatatggtttgcttttagtctcatagaaaactaaaaacagaaaaaggagtagaaagcatttccaactaggtatcaagctgttgaatccctgaaggcaaaatccattcttgccctggaaaaaatgtcttgtatatatgtagtgcctgcattaagaggagactaagttcatttacctttttctttattgcattattcagaggtaggaaattaagaatatgatccccttttctgaagacaaagaagtgtgttcccaagatactataggattaagctggccgcagtagcagtgacactaaaccacacttcctgccctgaatcacactcttttccctgccccagccctggaggtggaggttctcctgtgggcacaagtcatttatatacttgatcagtcatttatatacttgatcgctgaaggtagtgatttgagcttttccaggtacaggtactatctcatttaaattgttacctgggatgaaagaagcttctttagaagaggtgccacctccaggctgtggctttccccagcctgagcatccagtgttaggagagaaaggctccctgggtaaacagctggctcaggaggacttgttggagcatcttcccctctatatactttgtagactgaaccatgtaactgtgtgttgttgactgagtaaatgactgttatttcagtcatttaaaaaaatagcatgcaaaaagtcctagccttttttttttttttttgagatgaagtcacgctccattgcccaggctagaggcagtggcatgatcttggctcagtggtgcaacctctgcctcccgggttcaagcgattctcctgcctcagcctcccgagtagctgggattacaggtgcccaccaccacacctggcgaatttttgtatttttagtagggagggggttttaccatgttggcaaggctgatcttgaactcctaacttcaagtgatccacccacttcgccctcccaaagtgctgggattacaggcgtaaagcaccgcacccagccaaaagtcctaacttctaatatgtttatcagattagaattagcttttcttcatcatcatcaccatatttgcagtgatttttatgatgatgtttataactactaaaatgcctatatggtcttcctgatggtggtgtccgtgcgtgggagggagaacgttgctctataatgtattgtgctttcactgtaatgactcgctctgtgctctgaccggagtaatagccaccacttgggatggtttactgagcaccgaggttctatgctacactgagtcctttacatacattagtctacttaattttgcatcaccttttgaggtaggtatgaatagtaatccctgtagtaaagaagaggaaactgaggcccagattggttacatgactcacccgaggtcatacagctcacccgaggtcatacagctcatgagcagaggagccaagatttgtctccaagtctacctgacctaaaattgtgcttctgggtttagacatgtcatgtttagctttgatttgtttcccatagggaagaacatgtgtgccaaggtggcaggcctcgtgctcaaagtcctttcggatcttcttggccatgaaaaccatgaggtactcattcagcactgctggccctgggctcggggaggctacactggggacccaatgcctgtgaccccacaggcacacagctggcccaggatggttgctgtatttgaaaactgtacatgttctctgtccttctgggattttcataagcaactggaaatcttttataatttttagaattttggaagtcagaagcaggatgttctttccgtccctgtctgcttggcccactggcctgtgccgggcccctccggcattgctgtttctcatcatctagcccccaacattcctcccccacatgccattcccttggtatgtttaatgtatctctgtggatgtggatggagccttaaaagagatatgatactgtgtatgtgtgtattgaatttacagaaatagattgccctttaagtctcattctgtttatggcttttcccttgtgtttttaggacctttctatgttgctttacatatgtctagttcattaagtgtcactactgcaaaatagccccttgtttgtgcccctgacattttacttatccagcctgtacacttcgagtgccatccactctctgttgccacagcagtcctcagtgggcatggctgcacctgccccatgggagcctgtgccagagcttccagggatgtgtagacactcatcactactggctgccagcatacatcagtttcaggtcactgagtcctgccaaattgtcctccagaatggctatactagcgtttgctctcaccagtgttgccccaacacctggtgttattttctaagtttttaacctatgggccccaagcactttttaaataaagtagaggtatgtatgggtaaacaaattaacaaaaacaaataatcaaatatgattattctctcacttgccttctacaagtgccattgcagaaaccacggcaaagcttcaacaaaaatctaaccactttagacagatgagacccaggggtatatctgagcaggatacgattgagtaccacttggtttccacacatctgttcccatttctttctttcttttcttttttttcttttttctttttttttttttttttgagacagagtctcactctatcatccaggctggagtgcagtggtgtgatcttggctcactgcaacctccacctcccgggttcaagcgattctcctgcctcagcctcccaagtagctgggattacaggtgcccgccactacgtctggctaattttttgtatttttagtagagacggtgtttcaccatgttggccaggctggtcttgaactcctgaccttgtgattcacccacctcggcctcccaaaatgctgggattacaagcctgagccaccatgcctggcccgtctgttcccatttcaagcagacagctcccattctggtcattccattcacattttacaccagccctatccactgattggtgtgacttctttagcaagtggatgtttggtgtctttgtgacattcattttatattttaaagctagtgagctctgaactacttccaggcctgaatgaactctgttcctcactttattcaactcaggcaggtgaaaccagtgggaaacatattcttccatctcataataaaggttggtttcaagtactggaaccaatatgtctgctctgaaaacttaatagaccaaaggattcatcatatcattacctgctaccaatgcattggctttgaaaatgagctggatgggccgggcacggtggcttacgcctgtaatcccagcaattttgggagaccgaggcaggaggatcacttgaagtcaggagttcgagaccagcctggccaacatggtgaaaccccttctctcccactgaaaatacaaaaattagccaggcatggtggcttgtgcctgtaatcctagctactcaggaggctgaggcatgagaatcacttgaacctgggaggtggaggttgtagtgagctgagattgtgccgttgcactccagcatgggtgacagagcgagactctgtctcaaaaaaataaataaataaagtaagaaaaagaaaatgagcttgaaaaatgacatatatatatacatatatacatacatacatacatatatactttagagccaagtaatatgtttgctacactgtagtagtcatgatcttgaaagacaaaaccaaaataaagaaaaagatgcacataactgactatatgaacattacattttttgattggaaaaagatgccataatcaaagtcaaaagatgaatgaaaccccgaggaaaagttgcatcacatgtgacaaaagtttaatattcctaatagatgaagagctggtataaattggtaagtaaaagtcaagcaatccaatcgaaaagaaggataaaggatatgactagacagttcacagaatcgtgctgccccagaaacatgaaaagatgttcagtcgtgctagttcaatcgggaactgaaaataaaaacaaccgtaggatgcctttttttacccatcagcttggcaagcattgaaagtgctaatgaagtccagtgccgaaggagggcggtgggaaacgagccctcctccattgctgtggcaggcacagcgtacagcctgctgaaaagggaacttgcttatcagcacctgccatgctccatgtcccatgtgtgcaagtaaaacatgggtcctgtcttcaaaaagctcataataaaggggacatagtgtgaatttaaaaggatactgcctccagtgctgtagtggagggatgtacaagaagcggaagtgagtggcctgtatgggggcagtggggcgggggtgggttcaggagagccttcccaggagacatgtctgggcttagttttcaaggttcattgtatgtgtgaagaccattcctggcaaggtgaactgccagaacctggctgagacatggaacagcctggtggggggcatcccttaggtagtatggacactttgtggtggcagggaggaagaagcagaggtcatgagatagaggccaccccttgaagatcctgtgtgccacaccaaggagttccacctttccaactgggctctatggaaggtttcggagatggagagagggatgatttggcccacgctatagaatgttggtagtgatcgatggttacattaaagggtgaatattgagggtagagagactggtttggagatttgatgtagcctggttcatggacgatgatgtctgaacaaggacagtagcagtggatatggaaaaagaggggttcctatcgaagaggcttgaagacagtattggagactgaacaacaacaacaacaaaatcaacgatgactccagagtttctagcctgagtgattaggaagttaaaggtaactttaattaagcaatgaaatgcgcaggagtaagctttgggagggagtgacgaatttggttttagactcagtggtagctgtcacctgggcatgcagatggagatgtctgtcacttggaaacatacatcctggagcacaggagagctgcgaggacgggaacacccactctccccatttgccagattgttctgaggtgtggtgtttgatatagagttgtgcagtatttgaaaacttgcaaataactggtttttttcctccccttaaagatacagccgtatgtgaatggagctctgtacagcatcctttctgttccatccattcgtgaggaagcaagagcaatggtaagaaagcgtgcctgagaaacatgtgagcttcctttagtgccacagttcagagcttttagagcaagacctccttgattgggctccatagaaaggctcagatccgttccaaactccttgaaattgtatgtaaaatgtatatttgccatttcctggggagagagtctgtagcttttatcagatcctcaaggggatccctaactcctaaatggttaaaaattaaagtgttagaaagttcccagcaggctgacttttgcaaagttatagacattctgatggcaaccaaatggaaaagattataaaactgtctaggacttggtttggttggtaaatagtaaactcagtgtttaatgtgtacgttaacgcttgtatgtgaagtaaaaagcaaacctcaggtgattagtatattattttgaaaggacaagtgtttctagatctaatcaggaaaacaactagagttttgtcttttttctttctaccatgtgaaaccagattaacagtgtattaaatgctgtggtgaaaggattaaatatatttccaccttcaaaacacaggcaaaattctcattgagaccaacaaaacattcttctaattggttttgcttacttaaagaattgctaaatcttctcattgatcatttaaaattacatcaacagttacaccagagaccaaacttatttaagaaccattctatgtgatcacactaaacagtggaccttaattgcctactgcttttaaatttcactacagaacaggggaaaataaacttgcttaaattctgcgttatggtcatttaggtgaaagaaaggggttgtcaaccaaggcaaagaagaggaaaaaacatgtaggctgaagagaaagaatggaggtaacattcagtcaaagtgtgagatgcagcatggaggaaaggcaccagggcaaagggatggagggggtggggagtgaagctgaggatggggccatgtgaggaagagtcacagttgcaggttgtgagagcaggactgcccttagagatcccagagcagggagaaaaaagacggaagagagggacaacttccgaaacctatgtgacaacatcaggtctgacagatacccaataggagttccagaaggagacgaatgtgagcaaatggggcggaaaaatgattgaataaataatgaagacatggtgaaaaatacaaacgtaacagtaaggtgtctaggaaacccctaaatgtttggaaaataaacagcacactggtattagttatctattactgcataacaatttaccccaaagcttagtggcttaaacaagtttttgtttttgtttttgagacagagtctggctctgtcacccagactggagtacagtggcaccatcttgactcactgcaacctctgcctcctgggttcaggcgattctcctgtctcagcctcccaagtagctggaactacaggtgtgcaccaccacacctagctgatttttgtatttttagtagagatggggtttcaccatcttggccaggctggtctcaagctcctaacctcaagtgatccacctgcctcagcctcccaaagcgccgagattacagatgtgagccaccatgcccagccaatttttgttttagtttttgagacagggtcttgctcttttgcccaggctggagtgcagtggcctgatagtagtgcacactgcagcctccatctcctaggctcaagccatcctcctgcctcagcttatccagtagctgggactataggtgtgcgccatcacacctagctaattttttttaagagacagggtcttaccatgttgcccaagctggtctcaaactactaggctcacgtgatcctcccatcttggcctccatgcagggattacatgcatgagccgctgagcctggccattgaatttttaaattacagtcatgtcccatgtaacaacattttggtcaacaaaagactgcatatgtgataatggtccaataagattataataccccatttttactgtaccttacctatgtttagagatgcttagatacacaaataccaccttgttacagttgcctacagtattcaacacagtcacgtgctgaacaggtttgtacactaggatcttattagctatgccatatagcctaggtgtgtagtaggctacaccatctaggtttgtcacttactctatgatatttatacaataatgacatcatctcacaacacatttctcagaacatatccctatcactaagctaccaatgactgtttctgtgggacaaacattcaagagcaatagcagcgtagtcctaactaagagttgctcagtttatagttgagacttcagcctctgcttccaagctcactcacctggctgtcagcaggaggcctcagttttcttctggctattgactggggacctcattttcttcccccttgggcctctccataaggcttctcttgacatggcagttggcttcccctagaatgaatgatttgagagagaaagtaagcaagacagaagccccagtgtcttttagaaaaacctactctcagaaatgagataccatcgcatttattgtcttggttacacagacccaccctggtacagtgtggaggggatggaaccaaggatgtgactaccaggaggtggaatcactggggccaccttggggctggctgccacacactcctaagtaactgtgggtcaaagaaaaaagcacaagagaagtgaggggctattcttttgaaaaatattacaaatattttctcaattttggtttgtctttttaaattatggtagttagccagaagcggtggctcacgcctgtaatctcagcactgttggaagccgatgtgggcagatcacgaggtcaggagtttgagaccagcctggccaacttggtgaaaccccgtctctactaaaaatacaaaaattagccgcgtgtggtggcacgtgcctgtaattccagctactcaggaggctgaggcaggaaaattacttgaacccaggaggcagaggttgcagtgagccaagatcatgccattgcactccagcctgggtaacagagcaagactctgtctcaaaaggaaaaaaaaaattatagcggtcttggtcaaacatcagctttaatgatagccagatctgttaatattttccttaatggcttctacataggtttctagataggctgtgagttttggactttgaaaaggaaatgtggattacttacataaagatgtaagtagatgatggggcacggtggctcatgcctgtaatcctagcactttgggaggctgaggtgggtggatcacctgaggtcaggagttcgagaccagcctggccaacatggagaaaccctgtctctactaaaaatacaataattagccaggtgtggtggtgggcgccgataatcccagctactcgggaggctgaggcaggagaatcgcttgaacccaggagacagaggttgtagtgagctgagatcatgccactggactccaccctgtgcaacagggtgagactccgtctcaaaaaaaaaaaagacgtaagtagaataagcttccctctggcatttaacagagattaaagatataagccagggaggaacccccttttagcctgagaacgcatcagctaggcagttgcctacttaattatttgtgagagtgacctctaagggatgatcatgcccacaataaggtttttctaaaaccctgagatttccctcctttcgtgtttatccttgaggaagtttttagattgataaagccattatattctctttgcatgtaggtctcacatgggtgcatttgcttggcagagtttaggttgtatgcctgcaccctagctgaaagggaggctagaaatgctgaataatgaaggaaataagacaacaaggaaaacgtttcccacaattcctccaccttgacatctgatcgtgcacggtgctagggaagtggaggcagaattgatgtcctcagccctgctggtatttggtttttatttgtttatttttttgagacagcgtcttgctctgtcgcccaggctggagtgcagtggtgggatctcggcttactgtaacctccgcctcccgagttcaagcaattctcctacctcagcctccagagtagctgggattacaggtgcccaccaccatgcccggctaatgtttgtatttttagtagagacggggtttcaccgtgttggccaggctggtctcaaacttctacctcaggtgatccacccacctcagcctcccaaagtgctgggattacaggcgtgagccaccgcgcccggtgcctgctggtatttgtatgtgtgtcagcacagtccttctggaaagcagtttggcagttacatgaaaaatcactaaaggatctatcttttggactcattcattttcttctggttgttgatgcacagaagaagagctctatgcatgacaatgctcatttcaacatttttatgagggaaaagctggaagcaacataaatatctagtaatacaggaattgctaatgaaattatgattcttttgctcaaaatattaatatctattgaagatgataattaggaaaagcagtacgaagcagtatggaaaaatttattttactgtataatgagagataaaagcacagtatctaagaatgtatgtgctcatggaaaatgacacaatatacataaaaattacattagtaccaaatgctattatagtaatcttacaagaatacctaaagggaaaaaggagaacaaaataaatgaatcccctgaggcccatttgaactttaagagcctgccaaggcctggggctggagaagagatcagataagtggagctgccctaatacccactccccaggcctcctgcgactagggctggagtcatagtcagccatgggcctctgccctggggaccccaacaaacatcctgcccagggctggagccgatcagaggctctgcaggttataaaagctcccagaatctgggaaggccagggagctgggcttagaagccactcagcccagaggaatgtccaagcacaccatggggctgctctgctccagtgaccctggggcccacagcacaggcccatgatgccagaaactgcctccgctctctccagagggctgggtgctgctgctccccacccaacagaatgatgtgtattccccacgcacctgatcctccacattgcccacttctgaatcaaagtcatttgcttggcagaatctaggtggtgtgcctgcaccctagctgcaagggaggcttggaatgtgagtattctgtctgttgccttgggaaattaacagtgtagagaacctggttataaggcattcatcagccacaggtgtcacagttgtccattacaggtggtcagcctagtcactgtattccgtgatgctcactaggtatgggctttgctttgctttgctttgctttgctctccttcctttcgacggggtctcactatgtcaccaggctggtctcgaactcctaggctcaagcgattctcctgcctcagcctcccaatctcatgattacatgtcatgtaatctcatgtcatgcaatcatgtcatgtaatcatgtcatgtaatcatgagattacagacatgagtcaccacgcctggcctaagtatgggcctttcaaaattagtgtagaaatttttcatattcttggccccataattctacttctgaagctccacacaagacatgagcaaagatgtatgtatcagaatgttcattccagctttattgatcatagcagaagacaggaaacaatgacaagacctaacatgagggagtgactaagaacagaggccggaaggtagagtagttgagagtgggtactcctgagcctgaggctggcttcgaatcgtgttccaccacttcctagttggctagtgacaactgaagctctcagtgtgatcgtttttccatctgtaagatgaggattattgcagtaccaaactcataggattgaaagcattgaaggagctcataatatatttagaagattgcctagcgtgcagtaagcattgagatgttagctgctattattattattatagctatgaaaatgtagtttataagatttttattgaacatgaaaatgatcataaagttaaataagaagcaacatattatcagtatattctgagttacgtaaaacaatgtacataaaaggaaggaaatacttcagaatgttcccaattatctctgggtggggggcctgtgagtaatttttattctttcttttatgttgtttgcaagttttctatacagaacttgtgtcactttcataactagaggaaaatatttatatctacctgaaatagatatttgaatttctcaggggaaaatttcccttgaagacctttagtgatagaggattagactgtgaagctggaacgatagaatgcgctagagagttcagttgttgagtaaaagtagaagtgagttcgaagttagttgttctgtgtagtgttcagtgcgtgttgtcaggctctggaagagatgctttctctcatttaatccctcaaaggtcccctgaaggagtgactgcggttgtgcccattttgctgctgacaacatcaaggctgaaaggtgaaatcctctgcccagggccacacggccggcgaggggctacgcaccgtggtttgactccagagccctctgcacctgtgctgcagtatcactccagacttgggactttcacctagtcagacatctgcacatgacaaattgttttctttaacactatatatacaaacacaggcttctctatgattatctttatggtagtctttaatgatagctagctggaaggagcaggagttccttatttactttttgcacactgcttgtattcccatttttatgcatctggattattcactaggaccttttattatccttctgtcttcctggacattgttacctgacctaaattatctgaaatgacaagttattactttcaggataagatgtggttgttctatgacttctttctataatttagatcaaatattacctaatatatgtgattttttaaaaatacatgatattttggctgggcacacaactcacacctgtaatcccaccactttgggaggctgaggtaggaagactacttgagcccaggagttcgagaccagcctgggtgacatggtgaaaccccatctctacaaaaaatacaaaaattagtcaggcatggtggcacatgcctgtagtcccagctacttgggaggctaaggtaggagagtcacttgagtcttggagttggaggttgcagtgatcagagatcgtgccactgcactccagcctgagtgatagagcaagactccatctcaaaaaataaataagtaaaaatttttaaaaggggcttatcacactgctttttgcttgataactttctccttcctgtggcccttacattgagtgggggatggagaagagaggagagacacatttgtgagatagatataaaattcagctctcccagcagtgcagggccaaggcagtcattggttggtaactgtctctctggtacgacaagcctggccaggtgtccaactggtcccgcaggagcctgggcactgctggtccctcaactcatggacaactttccagagttcttcctcccttccagattgtcacctcctcctctgtgagcttacccatctctgcctcccagctcagtgttactgttccctaaggttctatcctaaccctctgctcttctctcactgccatcactggggaaccttgtttcttccctttgcttcagctaccagatctctctcctgagccacgaacccctactggacacagcaagcacaatcttgaccatttatcaagcatccactctgtgccagccattggactagaggctatttcttcaggtataatttacaaacagtgaaaagcacaggccttacatgggggagtttagtacatcttgacgaatgtgtatatctgcataccaacaaccagttatacactttgtcttttaaaaatttcaagtcaactcaaattgttatcctcatgtttatagttgaagaaacaggctagatgaagttgagtgatttgagtgaggtcacacattaaattcatgggggagctaattgcaattacaatactgatttaacttttctagaaggtagtgctctgttttggatgataagaactcagcatgttcaaagctgcacttggcatttctttaattcagttagagctattgattccaaactggcctacataaaaagagaacttgttggctcatgtaactgaaaagtccaggaaaatgttcaggcacagtttgatcaggggcttacatgccactagatccgtttctctggcagtacttctggactccacttcctctgttttgagatcattattagaagcactttcccctcacagtggttagaggcctcgtcagctcaagctgtatggactcattcaaatcctgccagggaagaggagggaaaggaattagacagtgtgcttaagtcagtatattatccctacttttccctggaattcttttacccaatattgaaaattctggcatcagggtattataataaacaatgtatagtgtagtgactttataattcttttaatagaaaaggaatgaaatctgtttaaagagaggttctattcatttacttctctaagcatatggtttcacttctcaatgatcatatttggccctaaaatccagaagacagtttataaatttagggaaaacacaggaaaaaaaaaactagctcccagaccaacatattgccaaaacttaaggcaatattgtgcagtaaaattttacaatagtttttttttttttttttgctaaatgtgttataattcagccagagagtcaataaaaagaaaattatttcactatgaattatgaaaaggataaaatgaatgtttagtataagccaaggatttttccttctgcccttgtgggaccagttggacacttggccaggtttgtcttgccaaagagatagttaccaaccaatgactgccttggccctgccctgctgggagagttgaatttttgtatctatctcttaaacatatctgtctcctcttctctgtcccccacccaaggtatcctcttcctctccccaaaacattattttttggattagatgagatgacctcattgaaaagtagtttccctccagacactgaaatgttaactattactttcgccaatacttctagggaatggaagacatcctacgctgcttcatcaaagaaggcaatgctgaaatgatccgccagatagaattcatcatcaagcagctaaattccggtcagtttgatgcaagaatctttgatctatcttttgaattattcacatttgccagaaagacacatggcatttcattcaagaggcctttaggaagccgggcacggtggctcgtgcttataatcccagcactttgggaggccgaggtgggtggatcacgaggtcaggagttcgagaccagcctggccaatatggtgaaacgctgtctctactaaaaatacaaaaattagccaggtgtggtggcttggcctgtagtcccagctactcaggaggctgagacaggagaatcgcttgaacccaggaggcagaagttgcagtgagccgagattgcaccactgcactccagcctaggtgacagagcgagactccatctcaaaaaaaaaaaagaggcctttaggaaggtggggagacccaagtgaacccatagacaaaagttcagccaggtaggctgagcgtggtggttcacacctgtaatcccagcactttgagaggccgaggcaggcagatcacttgaggtcaggagttcgagaccagccttaccaacatggtgaaaccccgtctctactaaaaatgcaaaattagccaggcgtggtggcgcatgcctgtagtcccagctactcaggaggctgaggcaggagaatcgcttgaacctgggaggcggaggttgtagtgagccgagattgcgccattgcactccagcctgggcgacagagcgaaactccttctcaaaaaaaaaaaaaaaaaaagttccgccaggtagtcaaggccagattgtccaaagattaacaatctcttatcgtactctaggcatatagtcaacaaaaagaacttagaagcaattacagaaaccctcccctaaccttgtaagttctctttatgtggcctctccctttcccctcctaaatcctgccccactattaaggtggcttccccagggtcctggggtcagataatgaaagcaaatgccactgtaagaaacttcatcattttcccacttttattcattcactgcagaaaaactgatgttgccaactgcagtgtggaaggaggcaatgtggtcctcattctatccagcctcctccattaccataacaacccacatcccatagtaagcaggagagaggaaggccaggaagcctgggatggggcagaggtggtagggaaagctcttcggctgtttctgtggactcctgacatcattcacctgccagaggtaccaagcactgctggaatccggggccaggtttgtcactgagtctctctccatgcccttccctgacacccagcagtccacatccctgcaagtcacatgcgtgaatcccttctgcacacgagcagaaagtgaagagtgagtctcaagagagctgcttggccaaggccagaagcccccaggtggcctttcttctagctcagggttcacagtctggctgtacagggcggtcacctggggagatgtttaaatctttaagactgtaccccacacaaattaaatcagaacctctcagagaggggatttcaagctcccagttggggtctcatgtgcagccaagggcagagcctcactgcctgggtcgcagaaacgagggtgtccaaggggctcccgatcaaaaggaggcagctgaggagagcagccagggagctttgaaacctttgtcctttttaggctgggtgcccatttgccttgaatatctcttctttgggttgtatggaacagctataattcatcccaaattcaggtgggcaaaaattagaactttattttttgcagtaacttcatttctgactctcagccctcattctggcatattgaaaaaaataaaaataagacctgaacctcagtgctgcctgaggttgctctcctgccttctctgggtaggccacggtgtgggggcggaggattgttgcacatccgcgccatagtcatcagctgtgcccagccctcccaggccaggagttctctgcattcagcctgagaatcttcttcaaggccacctgtgtgttttagtccactgagatacatctgtctccttgtcttccctccttcctggcagccaagaagcagggtgcaggccccctttactctctggcccaaaaaacatctttttctcttttataagccttgcccttggaccagcctgctagagtgggataaggggacaatttacacttttgtaagggatgtctctggaagaaattgtgttgggcagagctaaaccttctaaccctgggcattctggaaggcttgggaaatacctacttagttcagtaagttactgtttaaataaagagggcctaaagtatttatctttctatctcaagcacctaagttattctgtatccataggacagcggcaggagcccgccactttgaaacaaaattttacagtgattgaacattcagatggaagaccagacacacaagtacctcgggacatccatcaccagcatcaaatcaaagtgaaacccaggaggagagcctccatcctgtcttcatcctcaagtggaaattaatagcagagtacaaattgttgctagtgtatcagttcttaagatgtgtgaaatggcattgccaccatctttatttagattattggtttccttgttctatttcagtaaacttgaaaacatctctgtgggttttcacacgtccaagtccaatcacagtcttctagcacaatttttccagtaaagttttaaggtcttcaagtattaaaattcaagtatattttagcgacctaaccccacaggtggggaaggactattctggcaaagcctaaaggaaaattccagctggtgacattgacaacgccgggtgagctgccaacagcaacagcagagagatttgtcccctggcttgggcctggaccacaatgccagccctcagggaggggaaccagcaccagagagacaacaggggcaccagccaggtcactgggcaggagcaaggcagagcccccgggaaaggaatgatactggccattctagccccacgtgtgttagatatcggagtgcgggcacctcatggagtgtggaccaactcagggaacaggatgggagatagtcatcccagaaaggagctgaggtctacaaggcacttcacttctcaggacaggattattctgggtagtgggatgagtctgagccagcaggccttgaggttatggggtcaggagaaggggagctgggcaggaggaggcagagaaagagaagcgtggctgggctgtctgtggccttacaaaatagccaagagtcttaaaaaaggcatttctgtattcgaaaatgagcggtttataactgatgagtacagcagcacttcctgaaggtggaatggtgtatgctgttggtggatagggaagttagtcattaaacttcagccagaaagcagagtggcatcacatcttcatgcctgcacagtagctttctagactaaatggcattccacaacagtgctgcgacccgtggggcatgcaagcctcagtgagcagggggacactttggtgtcccactggcctcggtccagtgaagtcagtggagtccttccctttagaacgagcgttgggttgagaacatgggtttctacatcttccctcctgggaatggtttggtgtttgatcaaatgtgggtgcaccctgcctgccactttacaagctgggtgctctcctcaagtatggctttagttccttcttttctcctacttcccatttgacttcctttcttctttcaggctttctttaccttcatgtcatttgttcaagaaacaagtgataataagaaagatgtagtagggatagagggaggagtaagtcagctgctctgtccccagggactcacagttcagtgcagtgggtgagagacgagtcagtaagcattcattcattagtaagcagcaatcttccagaagtggcgtgaactgtcaggagttctagataaaacgctgagtgtgttcggggaggaagagatggctgctgagcaaggggatcagggaagacttcgtggaggagaaagtaccaacacctctgcagtgcctgcttcttacctggccctaagccgggcgcttcccttgtggtgtattgtgaggtcctaccgacaaccctgagaagtggctggtacaacccccattctacagaggaggaagccggggctctttctttctgtaactcctttgtgctaccaacttactgctcttttgtaaattcttaaaaagacctagcgatgaaccacagagccttcaggaaccctacctgccatgaccaccacccataccgcccgtggaaaaatcatggagtttagagatagactcggcttgaatctcagctgcctgccacttactggaagtgagaccaagaagtctctctttcctctctgtgcctctctgtaaaatgggggataatagtcaacaacatatttgtaaggattaagtgaaataacgggtatggcagaatctagcatgatgccttgaaataaatatttacttacttttccctaaattcccctaaaattatatgctggcttttaattttccccatgctactataatcatgttctggtaaaaatggagagatttactatttaaaattgcttaggatgatctcagacagtgactgaaatggttgtgattaggatggttaggagcatgatgactttgatgtaacctcattctcattaaggtgtttatgtctctgcagaggctgacagattctgtggaccaaggctcccactgtttatccattattcattgattctttttttctttatagaagagctaccagatggtgttcttgaatctgatgatgatgaagatgaagatgatgaagtaagttggaggttcttgacaccacatagaaaacccataccaaactattctctctttcctgccttgacaagttagtccagaaatggagatttttcattcctgctacactatttctcacaattctgagggttggctaaagctcagctgggtggtggttcgggtctcacttggggtctcatgtggggagcccagcggccatgtttgaagactcccacactcattgggttcacagcagagacgcagcattgcatgtcattcgagtttcatgggaagctgaacaatgaccattcttctgtgtgagcttttgctctgaaggggcacgagcctcggcctgtcttcctcaccggtgggagtgctgggcgtgtaggcgcctggcgagagtctctggcgtgaggggtcctgggtttagttcagagctaacggaactgaccagttttctctgttatttgcattcttttgacttgtgtttcctcagctgtgaaaaatctacttgcctggtgttttagagcatgaaggtttagaagttaatgtatgcgagtctctgaaatgatgtaaagaatggtgactcagggactgtagttggattttcagatgacaagattttacatggttttccttcagatacctaggaagaaaagacctgttgtcccctctggtcatccttgatttgcctgccttcatttgcagggagcagttactcctgcagtgaatgctggaacattttcatctattttggggggagcattcactgaaaaagtggatgtcagaggatgtttttttgtttggagtcgtggcctatcagcttgtaaaatgtgtaaaagccaggtttttgatcactgatggcatcagttgggaaagaggtatttaagagcccctgccagagaggatctgctaagatctgctgggagatgcttcctcagcaggcggcctctgtggctgccgttttcttcacaggctgcaggtggcatcagcgggtacgtgctcctgctggctcttcctgccttgtccagcagtgcagagcttgacctccagataggggtcctggcccctatcatcttctccaggcccctttgtttacaaaggtggaggcagagggaaaaacaccagcttgagctcacacagagagttgatggtggtaaaattgggtttagaacaggagtcggcagacactttgtgtaaaggaaaagataggaactattttagggcttgcaggccacacagtctctgttccaaccactcaattctgccattgtaacacggtggctgtcagcagtacataagtggctgaacgtggctgtgttcctgtaaaactatttatggacgctaaaaatttgaatttcatacaatttttgcatgtcattaaatattctttcaaatacttaaaaacacaaaaatcattcttagctggcgagcataggaaagcaggcacctgactcgtgggccattgtttgccagcccctaggcagttcccggacttgggcagccttctcttgattataatgagtcaccacctttgtgcctggcccttcaatatcattctaaatgatagtttaaattaatatttaattatttgtttttaacaactttttttcattgtgtcctaaagtttgtctcgagatctgttttcttcccttcttgtatcatccctttgggtttttcggtttgctttggtttttcattttgctttgtttttgctataaatcctgtttttatcttataagggaaaattcattttgttcaactgttctagttaatgatgagaactcaatttctggaaatttcattctgaaagcaattgtctactgtaaatgaacaaatacagaagtcttataattttctggacttttgctactcttttaagaggttgatgtttgaaaatacttgtgataactagaattttcagaagatttctagaagaggtttagttggaaaattataaggaaaagatctgtcatttgggccaaatgggactctgtgatgaaccccgggcagcagatgggggctccttctcccaggtaagcctcactgcgcatcaccggtgccagccggggcagtccgggcacagccggtcttgcctggattttactcagctttcaccggaggctagcattacgtttataactgtctttcaaagttggagggaaaaaagagagtgacagatcttaggctaaagaaaatttctaagaatcctttgagaagtagcactgttgttggaatgtggttatcacttcccaaggtgacagctctgaaggagacagcaaaattatttgcaaggtgttggagtcataccttatcttgcttagcagtgtaaatgttctttcatttaatatttagacccaaaacacagaaaaatgaaaccactgttttcagttagctgcttagcaactctaaagataaaatggttctaatggggccaggcacggtggctcacacctgcaatctcaacactttgggaggccgaggtgggcggatcacttgagaccagcctggcccacatggtgaaaccccatctctactaaaaatacaaaaattagctggttcatggtggcgtgcgcctgtaatcccagctactagggaagctgaggcacgagaatcacctgaacctgggaggcggaggctgcagtgagctaagatcctgccagtgcactccagcctaggcaacaaagcaagaccccatctcaaaaaaagtggggggctgtagtgggatggggcctgagaccagggtaaattatgctcactctaaatcacattgagctgaaatctgtgcgctcacaacttccaccactgctatccctgcttcactggaaactctcaagagaacccctgatgcaaagtctcgtttttctctgtaatttataatgacttgatctaatgtgctaacctaacaaagttatgtctgaatatacatacgtttatatactaaaattttaaaaaaaataaaggtagagctagaaatgcatcttctgatttatagactgtctaggatataatgtcaaatagaaaaaggaaatcataaagtaatttgaccaataatttcggaaaaagcaaatgtataaagacacagggctatggattatgtatgtgcctatgtagcggaaaggtgtggacatgtacgccctctttgctgacattataaactgcaaggggggaataggaataaggaagtttgggtgaaaaatgcagagaggccctgaggctcctcaagagagagaagtgagactaggacacggggtttagtggcgtggaagtcagttgctgtgcatttttgtgggttgatggagcaaaagcgaaatgaatggattgagggccaggtgggaagtgagaaaatggcttaagaagtgtatgctgctcctcgcccagtctggctgtgcacagaagagcaatagtggctgaagggggcatttttgtttgttttaagatgagagaaacctgagcatgttaaaatgctgatggagtagctccagccgagagggagagctggaacattcaaggcaggaagagtctacaggatggcattgaaaatatgggtgttttcattgttttctaaaccacttatactttcttggcccacaaagccccagacccatttaaacctccagagaaacaaaaccatcattagatcagcttggacaatacaccccagggaatggacaatgacagctgttatttaaggattcaaatgcatctcatttagcacttcagagaaatgtgttacctgatgcatttattttatatgaaacagacgtaatatgttacaaaagggctgttggtaaatcactaagcttaggagcctggttccgttgttctcacccccagtgactcaggtttccttactatatatcacagccagtttccttgtatggcttccttaagtagaaatgcaagaccttcctgtgctattctagaagactgattttaagacaaatattctcgcctcttgacaaaataggtttaagtgccaggtgaggtcagccgtggacatttacttgctggttgccatgtaagtgccaatcgtatgctcagcaatttccttctatacaaagtgctcagatctaagagttgctcatatatttactcaacaaatatttgagggcctcgaaataacactattgtaggaactaatggggaagggatgcaaaagaaatctaaaagagtatctgtggtttaaaatacctccaagaatttccagcctagatagggaagatcacagtgattctgacaacagcagctcccgcctgctggcagtgccgggtgccaggcactgttctaggcgccttatgggtgttcagtcatctcctcttcttagcagccctgtggtaggtgctatttttattcacatttcacagatgaagagacagagagaaaataggtcacttgccaagttcacacagctaataagtaactgtgatggggctgggattcaaatccaggtggtctgactcagtggtccatgctcctaaccactgccctatattaccttcttgtgagacatacatgaatgcaaaatagcaaataacagaaaataaatatgtgatcacagattcataaaggtgatagacacaggaagtgccacagaaattccaagtactccaggaatactgggagatggctggcgtggggtaaagaggaagtgagatgagttgaggaagggaagggtgtggccagcaggggtggcatcctctgggggagacagcacaagcataagctttatcctttgcctctccactgcactcacatcaacccccccaagaaacccatgttagtgatctagtgtgtgcatgcgctttcatacttaaaagatgcacacacagagtacacggaggtatgtactacacacagatccatatatacttttgtcagtatttgtttttcaaaatgagataacatagagatagaaatacacatacttctacaccatgttgcctttttctcttgttaatgtttcttgaaagtccttctgagttaggcagtgtagcaagttgatactttttaatgctatgaatgtataattttctagattttttgctatttcaaacaatgctgtagtaaaatctttgtaaaaatatccttatttaccagggcttttatttatatgggctcttgctgctggatgaaaaagtatttttttaataatagatttttccagattgctcttttcaaaggctgttaataattcagatttcactaggagaacatgaaggagcctcttccctccatctccactagcaataggtgctgttactctatttttttttaatgtttttgccaatctggatttggatttgctacattgtacatttccaatttcatatcctttctgtttttttcagttgtgcttctttccaaacccttttcaccatcattacaaatgttttaaagatatattttttctaatctcttttgccacaaatcttttttaaaattttttttaagttaaagattgaggcgggatgtggtggctcacgcctgaatcccagcaatttgagaggccaaaacaggcacatcacctgaggccaggagttcaagaccaccctggccaacatggtgaaaccctgtctctactaaaaatacaaaaatcagctgggcgtggtggtgcacacctgtaatccaagctactcggtagtctgaggcgcaagaatcatttgaacccgggaggtggaggttgcagtgatccaacatcacgccgctgcactccagcctgggcagagcaagactccatctcaaaaaaaaaaagttaaatatattcgcttttattttatagttcctgggtctcctgtcctggttaaggtcttccctaaccctaaattttacatgtagtctcctaggttttcttttaagattttaattttttcatctaagttgtagtcattaaatatgttatgcataggaaagaaaaacatatatgtttatataaggtttgaagtaaccattctccaatttttggtttcaggagccatttacattcttaaaaattactgaagattctgaagagttaatgagtattttgtctatcaaaattttttaaatgagaacttaaatatgataaaatgttaaatattaaaatattaaataacttaaaatggcaatagtaaatccattacattaatataaataagatattcttatgaaaaagaattatttttcaaaacaaaattttatgaaaaagtgtagcattgtgggtttgtttttttttttttttttttttttttgccaatctctttaatgtctggatcagaaaaacacagtttgatctgggctgtatctgttgtcatatgttgttttgattgaaggacataaagaaaatctagcctcacacacctgtgtacttggaaaggggtgaagtattttcaaagccttttcagatagatatttttgctcaatattactttaaaaccagacaggtaatagtttattaaaagttagttgcaatgtggaattagaaaccaattttaaatatcatttttattggctgggtgcagtggctcacgcctgtaatctcagcactttcggagccccaggtgggtggatcacctgaggtcaggagttttgagaccagcctggccaacatggtgaaaccctgtctctaccaaaaatacaaaaattagctgggcatcgtggtgtgcgcctgtaatctcagctactctggaggctgaggtgggagaatcgcctgaacccgggatgcggagattgcagtgagccaagatcacaccactgcactccagcctgggtgacggagcgagactccgtctcaaaaaaataaataaataagtaaatagtcatttttatcttgttaattaaaatctattgatctattttgcattttgttaatttgattttctgattgttccctaacaatcagatgtgctaatgtatagaaatacaattgattttagaatattgaacttgtatcctacaaccttactgaatttattagctcaaagagttttttgtttgttgtgggttttgggtttgtttgggttgttttgttttgttttgttttgttttgaattccttaggattttctgtataacaagattgtgtcatctgtgaatagagatcattttacttccttttcaatctagctatcctttattttcttgccttgcctgattgtgctggctagagactctagtacaatgccaaatagaagtggagagagcaggcatcttttgcttgttcctgatcttacagtgaatgttttcagtccttctccatctagtacagcgttagctgggattttttcatagatctgattataagattaagaaagtttccctctgttcctagtttgctgagtgttgggttttgttaaatgctttttcttcatcatatgagatgatcattctttgattttttccctttcatactactgatatggtgtatttatttatattgactttcagaccaggtgcggtggctcatgcctgtaatcccagcattttgggaggctaaggccggtggatcacctgaggccaggagttcaagaccagcctggccaacatgatgaaaccccatttctactaaaatacaaaaattagccgggtgtgatggtgcatgcttgtaatcctagctactcagaggctgaggcatgaaaattgcttgaacctgggaggtggaggttgcagtgagccgagattgcgctactgcactccagactgggcaacagagcgagactcagtctcaaaaaaataattatggccaggcgtggtggctcacgcctgtaatctcagcactttgggaggccaaggtggatggatcactgggtcaagagatcaagaccatcctggccaacatggtaaaaccccatctctactgaaaatacaaaagttagctgggtgtggtggcgcacgcctgtagtcccagctactccggagacaaaggcaggagaattgcttgagcccaggaggcagaggttgcagtgagccgagatcgcgccactgcactccagcctggcaacagagactgcatctcaataataataataatcattattattatcatattgcttttcttacttcccaatttctactggcatcctgcctgtttcatattttcaatagctcttttacccatgcaggattttgtattataattcattgatcatttggaaaatattggcttaccaagttttacagtttttccaaattttttgtttgtttgagacgaagtctcactctatcgcccaggctggagtgcaatggtgccatctctcggccagctgcaacctccgcctcctgggttcaagtggttcttttgcctcagcctcccaagtagctgggttacaggcatgtgccaccacgcctggctaattttttgtatttttagtagagacagggcttcactatgttggccaggctgatcttgaactcctgacctcaggtgatctgcccacctcgtcctcccaaagtgctgggattacaggtgtgagccactgtgcccagccccaaatgttgatacattttattatataacataagaaattgtgtattatcaacaccaatagcatcagaaaagcctttaggtattgggaagctattgagctcacaatggcagatataggtttctcaaaattctcattttttcttgaaagtttaaattgtattattgctgacaaatactattggttgttttccttaaagtgacaggctcacttcattaatttttgagaagacatctgctgtatacttaagtctaaataaccatagtctgtcagttactctttcaaatgaaaatggtgttccttgaaaaaagtggcttgcaactttatctcacaagtcccattcctgaagataaccatccgctttagtatagcagtactgctttatctgcctgtacattccaaaagatgggccataagggttaagagttaataaaattaattcctaccagttcatcaaggacagccttaaatgaaactctatctacctgtcatctatcatctatcatcatccccgtatttatctatggtgaaatacagtgactgctactagagtttgagatcgctgccttggtttgtgctaaggcaccagtggttttacccatcattgcttttgtatcatgagtggaaatgtcaatgcatttgttccaggataaaccatgaaagtcagtaaagcatccaacactttaagtatttcagccagtattacttgtgcttcgttgccaagtatttacataagagatctttgtgattagtgactgttgatactggaagattacaagcaaaataacaaatccaggcgtagttctgcagatgagatattaactcagcattcacgtttacagcttcatctttaattcgacaggctattgtttcattggaaagtgacactaatgtgatttcttttgtaactttccatccagcaggcattcagcagtggcagctgtacaaggctatcgtgtgtgtttctctagcgaaggcaatataacttacctaccctgcaaggttctttactggccgtgttttaaaattttgggtggtggggggagaataattttagatttacagaaaaaaaatagtagagaggattcctgtctacccatcatacagctgcagtggctttttaatttctagtttgaaaagtgataaaaaacaaatgttcaatttctcacttttaaagaactcatcacgatttaaataaactcatcactcatcaatatttaaacaaactcatcttgtttaaatagtcaaattctttttcattaaactccgaatgattggtctcaaaattgcactccaacttaactgacgtttacactccaacttaactgacatagttaaatatattctgttacataagttacaataaggtaaattattgacatctgtaaaactgagggaaagacagctttcatcatatttattttttactggcagtttcatccagcttctttggaatagattcctcccttccatgagtcagagaactttccctcccttattacttccctccttcttgccactagttgggattttgattgggactacattaaatctataaatcaatttgagtgttttataccatgagcatagtatgtctccattgttttgaggcctttttatactgtgcttcaaatctaatttaaatacctgatacataaagacttgagtcattgccacctttttttaatatccagaatcatttggagaataatccaatgtgaataaattcaaatgtgaatcatttgaagaagctaattggtagagttagaacagtataatggccaaatcgatacttttcttagaatttgagacaagaaatagaaaaatgtggctgttggtcacattagtgctataatggaattgtaatgaaacacagcatgacagatccaacaaagtgcaatcagaactagctagaccggggcatggaacttgtatacatctcgagagcaagaagttaaattcaagaagatgggctgaacaagataggaacaagctaattgtccaagcagtcaagagtaacaagatcttccaagtgaggcctaagaactcaggcaaggaggaaaaaaaaaaaatagaactcaggcaaggagacaataagaaacaacatgggacttgtaatccacacagaggatctgggcagtgagtcttgaacaacaggggaagcgacagtgaagcttaacacaaagcaagagttttataatcttattcttccttcccttcttgaccagagccacaggtggccttagcacggatgtggagctctagggtgtctggcccaaggatggtgctcagggctggatcattgagttcctctgagagtgcctctccagagggctccagtgcaaacctcaaggtgcccctggttttcctttcccttgccctggtgttctcccctctccatctcaattttgcctgggaacagctctgctccatggaaaagacagtttgctgctcacagtgccccaggggcaggggcgtgccacaccacagggagtcacacaaggaagcactggggtggagcaagaggctgagagaggggtaagtataggtgaggtggcataagcatgctgaggactgtttcgtttggatgaatttcagtgggctctcgagcaaaggggctttccctacttgtctggcacctagccctggggtgattagggcaggtggataatggccaggcgtgtaagagcccaataaaggagatggttggggtgtgagctctggattggttgatttgtatttggaaagcacacttgggggcaaatgttttaatattcctaagagctgactagttctggaaggggcagtccctccagggccaggcaagctccaatcaaagcatcagcgtagagggaatggaagacatggctaaaacatgaaacctccacagcctggcctcactgaatatctagtctcatctccctctcctctcggaaatggactctgggcctgaaggagttccagggaccttacatggccccaaaccccccttcttggttttcccacttcctttatcccatcattgctgtcaaccaggttccagagcagggacagttgactgccaccaggcatctggccataacgttgacattgctccccttgttattcagcccaattgacaaaaactgaagtctttcaaaaggaacttttattaaaaactaaaggaagaaacttagcaaataagagaggtgttcaagcataggttccagattgaaactgcagagcaggtgacatcccagctgaggagcagcaggagccaaggcaccagcctgatgctaaccaaggggggttcactttggccacagctcagggagtatggagggcaagggtgggagacaaagctggaaggatgaattggagccagacagtaaagagtggacactcactgaagatttgtgagcccaagagacgtgagcagagccatgccttcagaggactactctggcatcagtgttcaagttcactggggaccggaagagcttagtgcggcaacacagccagtattttcccagtgcttccgtgtgcaggcatgggccaagagcttccctggctttctcccgtgtattcccctcacccttctgccaggtgtgtgctattcttagccccattttatggataagaaaaccaaagttcagagaggttcagaaacttgtctagggtcccaaggcagtagctggtgggacagagatttaagcccaggctggcgtgagagcctgcaggctgcagcgggagtggggctgagcttggctgatggcagagggtgctcctggaggtgggacctgcaggagttgggaactcaggaggcatgacatgagtaaccaaaggctggtaaccttggaccctaggtagctgggaggatagcgatgccattaacaatacggggaacacaggctgggggtaagagcagatcatgtgtagggcgaaactagattttgcacgtgtcaggaggcacaacaagatgatgtggctagaacggaaaatgatagggcatagaaccagacagttcctgaccagccttcctccaggtgactttgcattccatacgcagagacatactgttgagggtttggggcctcctttctcttcggccaccttcatacgtgacctgtgagattgtggacccacttgaagctgcttctaggtgcatgtccagagagccagaggctagctgctctccatgaatcagtcacctctgatgggtcacccatcgtggccagctcgcttggcatggccagctcgcttggcgtggcacaggctacgcttctaatccccgttacctaatgagtaaagaagtgtctgtcttatgtctgtgttacttgcaggacctttccattatttaaccaagtcaataaagaaaccagtgtttcccaattaaggcttttgcttctttctggtaccttttcagcttctaaattcgtttatttctgcaacactgctcgtgtgctctcagaccctggctgggatgcaccacccagcaggctgactcatggctcctgccctcatttccactctggtttctatggaaatagacatccgatggctcaaaacaaggtgagggcttgtagacacctcatgattcctaggcatttataaaccctatttgtccaacatcggttgccttggaaacaggtgcagaaaaggttttctctcttatctgattttttaaaaattttaccaaagcagtgatgagtttttcctgttatcacggaatttgggaataatagtacattttatgtagtgaagcatatttctagtttttcattatttgataaataaatgcattctacattatttcattttacaatatttatttaataaataaatacgtttctatccatttgatcaaatcactatcacttggtattcaaagatgaaatgcttagcgtctgggtctagaaatatgactggagaaaaaatgtgtatggcctgctgttccttgcaacttcagaattcgaggcatctagggcatagatgtcttgaattctgaagttggaaggacaacaggccatataccactttttacaattttttttttttgcaaaatctaagatgttttttccaattgaagttagagtttaagtgatcaaaactgatgtttatgctgaaccttagcaagtgggaaaatccaactaattatttcagtcttatactatcctgaccaaggttcttggcttgcatcgctgcttggttttaagagctcagggtctgtttactcaaattgagccattttatatctaaattctgtgtgccatccatgttatgtaaaatatggagcatgtctgttatagaaaacatagaaatagaagcaattttctgttaatcgtgagcaagtaagcaatgcaccatactcggtttagtggagtgacgaggactacataactaactgatagtcattcattaagcatttgttaggcatggtgtattaaagttcagctatggggccgggcgcggtggctcacgcctgtaatcccagcactttgggaggctgaggcgggaggatcacctgaggtcgggagttcgcgaccagcctgaccaacatggagaaaccccgtctcaactaaaactacaaaattaggcaggcatggtggcacatgcctgtaatcccagctacccaggaggctgaggcaggagaattgaattgcttgaacccgggaggcaaggttgcagtgagccgagatcgcgccattgcactccagcctgggcaacaagagtgaaactccatctcaaaaaaaaaaaaaaggtaaagttaagctatgggcgggtgcaatggctcacgcctgtaatcccagcactttgggaggccgaggtgggcggatcacctgaggtcgggagttcacgaccagcctgaccaacatggagaaaccccatctcaactaaaaatacaaaaattagccaggtgtggtggtgcatgcctgtaatcccagctacttgggaggctgaggcaggagaatcgcttgaacccggggtaggggggaacggaggttgcagtgagccgagattgtgccattgcactccagcctgggcaacgagtgaaactccgtctcaaaagataaaaaaaaaaaaggtaagctgtgatctgctgctaggggcagtccaatctttaaggggaaaagcagagtaagttcacttaaaatagaaagacagaaaagcaggccaggcacagtgactcatgcttgtaatcccagcactttgggaggctgaggtgggaggatcgcttgagcccaggagtttgagaccagcctgggcaacatgatgagacctcatctctacaaaaaatttaaaaattagctaagtgtgcttgtgcgtaactgtagtcccagctacttgggaggctgagatgggaagatcgcttgagcccaagaggttgaggcttcagagagctgaaatttgtgccattgcaccccagcctgggtgacagagcaagactgtgtctcaaaaaaataaaaataaaaatagaaaaagacagaagcatagtgaaagttaatgttgctgtgtggggagggacactgcagagaatttgctatgcagctcactttgcagccggctgtgtgctactttctggcatttattttcatatcctctttcctggtggagtcatttttttttcttttgctgctattcacactaccttttattctgtgttagtgaattgtaagtgctgctgggacagggccgtatcagtgtggttctccagaggctcctcactaccggcacagcacttggcacataccaatggtggggtaggtatttgctgactgagcatgtgccccgtatagaacactgtgcaggggttctgctgggcgcagttgctcacgcctataatcccagcactttgggaggccaaggcaggcggatcacttgaggtcaggagttcgagaccagcctggccaacatggtgaaacaccgtctctactaaaagtacaaaaattagccaggtgtggtggcatgcgcctgtaatctcagctaccctggaggctgaggagtgagaatcgcttgaatccgggaggtggagttctcagtgagccgagatcgtgccactacactctagcctgggtgacaaagtaagactccatcgccaaaaaaaaaaaaaaaaaaaaaaaaaatattgtgcaggggttctgatggttcctttccgcagagaatcccttcatcccttcagaggaatgtaagaaggcagattcacccaatcccagcctggagaattttcacaaagtgcatatacctatgtaattcagacaccacccaccccctcaagttcttgacctcttcttgaaatttatataaatggagttattcagtataatatactcatgtgtctggctcatttgatcaatgttatgtttgctaacccccaaaaaactaccccaaatcttagtggcttaaaaaacaataatattttcctcccaattctgtgggttggcttggcaggtcctctgctggtttcacctggacttactcatgtggcttcattcggctggatgtcagctgggccggaaggttcgaggtggtttggcagttggtgcaggctgccagtgcagtgtgcctcagttctccgccacgtgacttcactcctccagtgagctggaactgggcatctctgagttccaagaggttgaagttggaagcttccagtcctcttgaggctgaggctccagaattctcagggcctcatttctgccaaattctactgtcaaagtcacaaggccagcccagtctcaaaggattagaaaaatagacccttccctgcatgggatgagtggcaaagccacatagcaaaaggatgtccttgccaggatggcaggagtttgtggcggttaaacagtctgctacagggagattcttctccgaacaaaccgtttgaagatagtctttgtgtgcaaaacagccttttacagtttcacacactttttttttttttttttgcaaaatctaagatttttttttccaattgaagttagagttttggtgatcaaaactgacatttatgttggcccttactaggtgggaaaagccagctggctatttcagtcttatactaccctggccttaccacgctctatcctcagttcttaatttcagaaacgttaccattctttttctaacaaaaaagtagtattgtaaggactcaatgaactaatctgtatattatcctgaacagagtgccttgggtgtatagtatacattcggttcaggcttgcttttttgtttcctcctagttctcccgagtggatcaagctctgggaatgttgtaaaaactgacttggctagaattcatctatttaacaaatatgtatcaagcacctgttatatgcccaggtctattctatatccttagtgtttttttctgtctactcattctaccagttactaagagaggagtatagaaatctccaactaaattgtgaatttgcctattttccctttcaattctgtcagttttgggttcatctattgtggaattcatttgctttaagcatatatgtttgtaattctatcatccaacagtgttgaccctttatcaccatgaaatgtcctttgtctctaataatgtctctagaatatttggtctgtccaatattaatatagccacttcagctctctcatgcttgctgtttgcatgacatgttttattcttttactttcaacctattcgtgtcttttaatataaagtacttctcttgtagacaggatatagctagcttttgcttttttaatccagtccgacaatctgcctttgattggagtatttatttagtgtgttcacatttttgacagttttattgaggatataatttatataccataaaattcatctgttttaagtaaatgtataattccatgaattttagtaaatttatagagttgtgctaccatccccacaattcaattttaaaatattttcatcaccctgcaaagctcccttgtgcacatttgtagtcagcccttgcctgggtcccccacccccacaaaccccaggtaaccatcaatctgcttctgtctctagatatttgccttttctggagattttatatcgtatgcatgtggctagtgttttcattttcttttttttgtttgtttgagacagggtgtcactcttgtcacgcaggctggagtgcaggggtgcaatcacggctcactgcaacctccacctcctgggctcaagggatcctaccacctcagcctccttgagtagctggaactgcaggtgtgtgccaccacttctgcctaattttttttttttttttttggtaggacggaatcccactatgttgcccagggtggtcttaaacttctgggctcaagtgatcttcccaccttgacctcccaaagtactgggattacaggcatgagccaccacaccagccatcttttctttttttttttttttttgttttttgtttttgagacggagtttcactcttattgaccaggctggagtgtgatggcgcaatctcagctcactacaacctccgcctcacaggttcaagtgattctcctgcctcaccctcccaagtagctgggattacaggcatgcgccaccatgcccggctaattttgtgtttttagtagagatggggtttcaccatgttggtcaggctggtctcgaactcccgacctcagctgatccgccgccttggcctcccaaagtgctgggattacaggtgtgagccactgcgccaggtcattttcctaatagtgtcttttgatttgtaaaagttttttattttgatgaggtctagtttatctttttcattttttcatttatggtctctgcttttgttgttgtatctaagaactttttgcccaacccagactttctcaaccttggcactattgacattttgggccagataattctttgttggggaggctgtgctatgcgttattgggtgtttagcggcatccatggcctctgcccattagatgctagtattaatccacccctcttcccagttgtcacaaccaaaaatgtttctagacgttgctaaatgtcccctaggaggcaaaattactcctagttggaaaccattggcctaggccaacattgcaaagattttcttttatgtttccttctaagggctttgttgttttaactcctatgtttaggtataggaccatttttagttaatttttgtgtgtgatgtgagataaagatctaaattcaccctcctgcatatgaatatccagttgccccagtatcatttgttgaaaagactattattcaacccgttgtattgctttgtcaaataacacctttgtaaaaaataaattggccgggtgcggtggccataatcccagcactttgggaggccgaggcaggcggatcatgaggtcaggagttcaagaccagcctgaccaatatggtgaaaccccatctctattaaacatacgaaaattagccgggtgtggtggtgcatgcctgtagtcccagttacttgggaggctgaggcaggagaatcacttgaacctgggaggcagaagttgcagtaagccaagatcatgccactgcactccagcctgggtgacagagcaagactctatctcaaaaaaaaaaaaaaaaaatgctggacgcagtagctcatgcttgtaatcccggcactttgggaggccaaggtgggcagatcacgaagtcaagagttcaagaccagcctggccagcatggtgaaaccccatctctactaaaaatacaaaaaaattagccaggcgtggtggcgcacacctgtagtcccagctactcaggaggctgaggcaggagagctgcttgaaccttgcaggcagaggttacagtgagccgagattgtgccactgcactccagcctgggcaacagagcaaggctccatctcataaataaataaataaataaattgaccacaaatgtaagaatttatttctggactctcaattttgttcacttgattcatatgtctagctctatgctagtaccacatgatgttaattactatagctttatagtaggtttcaaaacacgagttcttcaactttgttttctttttcaaaattgttttgtttaatattcatattaatgtaataattgatacggttgggtttaattctgccatttgctatcagtgttctatttatctctttgttactctgtccttcctgccttcttttgtattaagtaatatatgtactgctgccctttgtattaagcaaatattttttagtaaaccattttaataactctactaactttttagccgtatttgcctttttgtttgtaagttggttctagggattcagtatgcatctttcacttgtcacaaactactttgagttaatactgatttattactggtcaaatagaagaactttgcatcagtaggctcgatttctgttcctcttttgtgctcttgttgccatatttgctacatttatgtttattatcaacccggtgctataaatagtcatgtatcatttaaagaaggaacatgtgtgtatgtatgtgtgtgtgtgtgtgtgtgtgtgtgtgtgtgtatctccacctacatatttaccatttccagtgctctgtaatgctggtctcttaacaacaaattctgttttgttttttttttaatctggaattttctttagttcaccttctttttaattgctacttgatttggtcaaaacaccttcatttttgaagcatagtttcactgcatatagaattcttagttggcagggcgcagtggttcatgcctgtaatcccagcaccttgagaggccgaggcaggtggatcacctgaggtcaggagttcgagaccagcctggccaacatggtgaaaccccatctctactaaaaatataaaaaattagccaagcgtggtggcacatgctacttgggaggctgaggtgggagaatcgcttgaacccaggagaatcacttgaattgaggcggaggttgcaatgagccgagatcataccactgcactccagcctgggtgacagagcaagactccatctcaaaaaaaaaaaagaaagaaaaaaaaagaattcttagtcaacaggtgttttttccccagcacttttaataggtcattcttttgtcttctggcttccattgttttgttttgtttgtttgtgacagagtctcactgtgttacccaagctggagtacagtggcttgaccttggctcactgcaacctctacctcccaggttcaagcaattctcatgcctcagcctcctgagtatctgggattacaggcatgcaccaccacacctggctgacttttgtatttttggtagagatggggtttcaccatgttggccaggctggtctcaaactgcgcccagccccattgtttatgataagaagccagctgttaattgcatattttatcattgctcccctgtatgtaatgggttgttttccccttacttttgaatattttttttctttggttcttagcggtttgtctatgatgtacctaggtgtgggtttttctgtgttaatcttttttagggttcatggaacttttttttttttgagacggagtctcattctgtcgcccaggctggagctcaatggcgcaatcgtggctcactgcaacctccgcctcctgggttcaagcgattctcctgcctcagcttcctgagtggctgggattacaggcgcctgccaccatgcctggctgatttttatatttttagtcgaggcagggtttcaccatgctggccagactggtctcgaacacccgacctgaggcaatcctcctgccttggcctcccaaagtgctaggattacaggtgtgagccactgcacccggcctggaacttcttggatctataagttacagtgttttttttgtgtgtgtttgttttggggtttttttttttttaaaccaaatttgagtagtgtataaccattatttactcaagtgttattttctgcccctttcctctcctcctgaaaatccagttgcacacatgttagaatgctgatattgtctaacagatttctgaggatttcttcatttttatccaatgtttgttctcttctttgagctggatactttctgttgatcgtccttccagttaactgattcttttacccttttgtatctgctgttgagctcatctattgaattcttcatttcagttattgtacttttcagctctagaattcccatttggttcctttttatagtgtctatttttctgttgagatttcccgtttttcactgattttcagtattttttttaaaacttctgagcacattttcctttaattctttgagcatatttataatagctgctttgaagtgtttttctactaaatctaacatctgggcccactcaaagttagtttctcttgtctatttttcccccaaggacaggtcacgctttgtttctgctgtatctagtaatgcatttggttgacaaccagacgttatagataacgtgttgtcgtgattctagattacgttttgctctcctgagggctgttgctttcatttgtttggtaagcagttaacttgcctgctcttaaactgagaaatgtgtctcccctgtagaaggcagccatgagtgtgtctatcattttctccaatcccagggtctcccctccataatttaactgttgattgggatggaaattgtgctcagatgcctgaagccagtaaggtttccaccttctgctgcttgagctgtgtgtggattgaggaatacatttgcaagcacaaaaaattatctgcaagttttcccacactgttagcttcctctgggttccttgggttttctgcatgtacctgtagtttagcagtcagagatgtggggagattgtaacatctcttaacctctgtagccctcttgcttccagctgtcccccttcaatttctagcagctgtgcctgccacttgccctctaccacgttcacacctccaggccctggggtgtcactgcctacgatgggaacgcctccaggcaggaaggccatgaacacacagttctcacccagtgccctagcacttccccactgagcaagtactgcttaagttgttgcctgccattggtcattttccagtgtcctggaatgattatttttagtaaacgtatcacattttgcacttgataactgtagagaggaattgcctgacctactcctgttccaggaacaggagtatatgcctagggccagaagtcgttagatcctagggatatagcggtaaaagcaaagcagacatcctatttggagaaagcaagccttcaacaaataagcagagatgatagccaggtgaccatgagtgctttgaagagcagtggggcagagggaagagcaagtggcaaggtcctgaggcagaagcatattgggggccttgcgggaacaggaagaagcagggagggagttggatatgaggtcagatcacctagggcctggggaaggaccttggcttctatcctgagagaggagggaagctgttagaaggtcactttcatttttaagtgatcaaagtgctagtttactaatttacagtgagaaataaaactgcctgagtgaggtcagtaagtcactgactgggctgggctattcctgggacttgaactgagcccaaaggcgctgggaccaggtagccttgtagagctcatgaacatccaggtggaagtggccattggctctgccaagtgtcccccatcctaggatcaggagccctgttcgggtcctgattctgccatgtacaagccttagtttctctaaatgggctaaaactaactgccacgaacctgagcaatgctcagcccagcatctcacccccatgctaggcactagtaaggggttctaacccagatgtgggcataacaaacacctgaggctcataaatcacctggcggtcccaggcgcccatgctccttaaactgctaagtgaccagggactcttcctctcccttacactttgctgtcatcttccagatggtgtctacacactgtggctcatcgttctggaagtcactttcatcttccccttcatttcctttctgctccacatcctggcttaagcctcacacccctctctgtactaacttcccagccttcggtctctggccctcccagcttgtcctgcatgtggccaccagaccatcttcttaaagcagagcttggaccacacggggacatgatcacttaatttttaaattagggaacattttaaacttttcagaaagaacagaaaataatataacagacagctgtggctgtatcccttcctctccctcccctccttctctccccagaattaaccactatcttgaagttggtgtattaattccacagatgattctgtactttcataatatacactgttatggtttttaattttacataagtggctagtattatatgaattgtttactggcttgcttttttcattcaacattatgtgttagaggtttactcatcccaatacccagttcacccacttagctgctgtatgtagtatttcattgtcagaataagcccctgtgtgtttctccttcctttcctgtgttttccacagtgcagcaaagagcttcttcatcctcgtgtccttatatgcccttgagtgcttctctgcagctcacacctagatgttgaattgctgatgcagggggatgagggtctcatctttactaaatcctgccaaattgctccccaaagggctgacccatttgcacattcacatgatgccttttaaaacactttcttgctccccatcacttggcacaatctcaagttgctaacggtagtattcaaagcctcactcattaagaccctgtctacctttatatttttatttatatttgttttttcatctgtaaaaatagggataaatcatcatgacagagatgtgaacagcaagttcatctgtggcccctcatggacaaaaaaaaaaaaaaaagatagtgtcctttccttccttttcttccgtatagtgtccactcgctggtctttcttctggagctatatagaataagcctaatccagaaaaggcagtggcagggggtggcattaaagccaaggctgggacctgtcttaatccctggtaggcatcttattggcaggtgagctgatggtcacagctcactgaggtattggatcacatccttgtcttgtatcatgtgtgcatttgatcagcatgctcttcctgtccttattccaagtccaaggcaacagggaacaggtggggccaagcatggaagcctctctatacctgccagagacccacaaaaatgatagatgcatggttaatacttgctgaatgtcgagtcagtgactggcagaatctgaacaccaagaaagggttcagaagctaactccctgtgtttgagtcctgcctgacaacttaccagctgtgtgtggctttgggcaagctggtgaacctcaccaagcctcagtgttctcatctgtaaagcgagaatattaatacccttttcatcaggtgcttgtgaggatcaaatgaaacaatccatgtcaagtgccaggcagactcaatgcctgtcagctgtttttaacgccgcccttgcgatctagagacagactggcctgactggtctagaggcaagccgaagtctgctggagtggaggttcctcatgtgctgcctggccagaattagagagagccaaggccagggctggcccggatggagcggggatggaaagcagctggcagagaagtagagcaccctcagtggggaaaggaggggtgggaggaggctggtcccaggccacactttgggtagcagcagcctgggagtttttcctgaggttttttctgtgaaactttaagattcatctaaacagtatttcagaacatagacattatattgaataatagttttttttgtctttatgacattcctgctggcatgtaagaaaatcccttcattgggtcaggagtgtgtccagtcctggagtggtggtttcttcttaactagcccatcttcacttgctccaggttggggcggggacataccctgccttggtccctaggtcttttgttcccctttgcccgttgtgtcctgagcacactcttaggatcctgtttggaaggggccctgatttcggttaccctcttcctcttctccatgtgaagcgcggtgtctgtggtactgctggggcactgggtccctctccctctaacctcatggaagctttctgctctttcacttcctgtcccactgagcctccaggtcttctcttattgggtgtattaaatattgcgataagccctgcttttcctagggcgactttgccatcatctccacatttcttgctgtttttgcttagagtacagaaaaagtttaagcaagtaaactgagcggcgaaagcaagagactgggagaattagggaagtaaaggttgtttgggttctccggtttctgtcatatccttatttaatgaactggtctggttgtgaaaccaactgtcataccctgggctgcatttttgtgaatggggaaatgaatgtagagggagacttctccgcgtcgcggggagccctcaaggatcccggacgtgcttccatctgcagtcgtgggcacgtgctcaggaggaaagctgcacacgtggccagggcccattccactggggaagtcagcgcctcacgctgcctggcctggtcacctcagtccaccctcgctctcccatgtggagtgtttttcccttattttcacaaagagtgagatttacaattcagcgttctgagaaggtgtctcaaatttaaactacttatagaagtcttataattatttcaagtggaaagcacaccggatactttcacttgtcatgtgtaaaaccgcctgaacacattctgctctgcattctatctgtaagaatctgagttttcaaatgcatttagtggtcacccttagttttgttttcaggccagttgcttagaatctggtttgtctggagtattatgtatcgaaagcctccagttaagcatcttgtaatgtcataaggtcaccaagctgccatggggaagcttcgcattaggacatctaaattcatctcagctcgagcgccttttttatgaggcattcttaatttcttgaagtaatcagttatcactgagctctaacattagtaatctgatgcattctgctctggtacataaagaccagtaattttagtcaaattcctccaacaatggtatttaagacccaccctaacgaggcatttattcttgagtatttctttatccatcactcccttacttcacaaagtagattttaaaatatgtcgtttcgtttggaattcacaagcagctcagacaagttagcacagtggctggtgcccttgtcgcccagtgcacccagcaccttgccaggcttgcattgagagaggctagcagaattctttccccgagcagggcacggtggctcatgcctgtaatcccagcacttcaggaggctaaggtgggaggaatgcttgaggccaggagttagaggctatagtgagctgtgatcataccactgcactccaacgtgagctacagagcaaaaacctgtctcttaaaaaaaaaaatggggggagaactgatggcagcagtggctcccctcccagctggaaggcctgagttggcattctcagagggtgcctcttggcctcacctctgggtttgcccattattaaaagtccagatacatcctcagagttgttttcatctgcctggcactgattgagaaagtggagcaagcgcctgctatcagcaagcttcattgctgggaggttctctgcttacatttcccaccgcaggtagtgggctcctctgcctgcaggtgttactgggaacggttgaatgaagctctggcttctttgttaagctgcccttcccacctcaactagcgcagctcagtttgcttccgctctctcccctcccaagccctaaggatgcctccgttcccttttcgccggtttcagtgtttctcagaaaccatggcagtgacttgtttatatctacacagtatcatggcgttccaaaagcagagaatttaagaaatttcttccatcagtaagtcatgattttaaaggaggcagccaagtgatcccatttactagctagagaaaatgaggcgctgacaagaatcatgtctttctgaattagaaccttggtacaaaactttttaaaccaagaaccatcaatttggtgatgattttcacctcagttttcttacatctatgcatttgacattgaaataacaatagcgtttgcctgcatgttgcactagagaaactgaggcagcggaagccaactgtccctgttgtgagcaggtcagctgcggggccctggttctgccccaggccccctgctcacactgctaagctgcaattcaagttaacttttattaatgggtagcaaatattaggaacaaatgcagaaactgtcctgtgtttctggaggttagggagggcctatcaattctcagcaaatttaattgtaaagtacttttttttttttttttttttttgtgatgtagtcttgctctgttgcccaggctggagtgcagtggtgcaatctcggctcactgcaacctccgcctcccaggttcaagcgattcttctgcctcagcctcctgagtagctgggactacaggcacacgccaccacgcccagctaatttttgtatttttagtaaagacggggtttcaccatattggccaggctggtcttgaacgcctgacctcgtaatccgcccacctcggcctcccaaagtgctgggattataggccacgcggcctataaagtacgtttaattaaaaaacagctttgttttaattaaaaaaaaaaaaaaaggccaagcacagtggctcacgcctgtaatcccagcacttcgggaggccaaggtgggcagatcacctgaggttgggagttcgagaccagcctgaccaacatgaagaaaccccgtccctactgaaaatacaaaattagtagtggcgcctgcctataatcccagctactcgggaggctgaggcgagagaatcacttgaaccgaggaggcggaggttgtggtgagtggagatcacaccattgcactcagcctgggcaacaaaagcaaaactccatctctaaatagataactaactaaataaataaataaataaaataaaccaaaatgaagacaggtacagtgactcacgcctataaccctagctattcagaggctgaggcagaagatcgcttgagcccaggagttcaagtccagcctgagcaacatagcaaaaccccatctcaaaaaaaaaaattttgtttaattaaaacaaaacgagctgggtgcagtggctcatgcctgtaatcccagcactttgagagtccgagaggggtggatcacttgagctcaagagtttgagaccagcctgggcaacatggaaaaaccctgtctctaccaaaaatacaaaaattagccaggcgtactggtacatgcctgtggtcccagctacttgggaggctgaggtaggaggatcactggagcctgggaagttgaggctgcaatggggcccttgattacgccactgctttccagcatgggagacagagcaagagaccctgtctcagaaaataataacaataaataaaataaaatggaataaataactttaacttgtgattgagatgtgttgtttgctagtttgtgtttatgtaagttgatttgcaagtaaatgggtcttacatatgtacttgtccaggataaagaaacacttttgctggcattgactgaagttagccattgactatgtgtttctcgttgaaatggaatatggacatttattttgtttcttaatgtttcgtattccctcctggcagggaagtagtgtctcaccaataccttggtgaaactgtgattccaatgcccatttccagctggggcctctgaggctctgtcccctggagaagaggtgaaacactactccatgcccagagctccctgccactcactcagaccacagagctgctgctttggttcacaaggagtactcattttcctaaaattcatcataaaatgcacacacaccctttgatcactgagatgttgttattttggtgaagtactctaagccaaggcaacaacctcaatcttccgtaaccgtcccagagttgacttggggtagggcctcacaacaggattacctttaaggaaatttcaggacagcgggtctgctagcacttggcagagctggcaactcaggtgcagcagcagaagaaggtggctgccctcaccatagggcatgagtcccaactagagcttaaatcgcagtggtaactgtgagcctgggccctgggtggggcaagagtggattctccatttgtgattagacaagagaaggggagagagagggacgagaccctgaacttcagatgccactatagccctccctcccattactctctgtgtcctgttgagctcagtcttagccaggcagcagggacccaagctgtccagcctgtacctcctcagaaacaggcttcttctgtggggccccaagaggccaagtcaaagacctgggcagaaaggggctgccccaagcttaaagtccagattcctagactcagagctgggctactgctgtggatttgtcacttctctgggcctctgtttccacaccaggaaaatccacaccaagccattgtgaaagttaagatgtaaagtgctatggaaatgtaaggtgggttccttaattattctatgacaagggacatcaaataaatgcccccaaatgcaagctagcaggagcagcatctcctcagtagccccttccctgagtaagatggtgctgattgttggaaaaggctctggattgatctggggcctgcctcttattctgctggttcaggcctgtctttggggacagcctagagtaagtcgaatccccttttcttaggacagcccatcccaaggtgacaccatctagtgatggcaggtggcactgactatgtggttgagagagtggagaggcggggtagcttcccccagcgcagccctaggacaggcagcatcacatttcaaggcccagttcccagccacaacctgccttccaggcccaggaggttgagccttcatattccttggaaactgactggggcaaatcaaactcaccaaagaccagaacatcctgaataactagaaattagtcggaaatgaagacagggtactcatttttgcagaatagagctttctctgcctgttggcaagtgtcaaggagccaattatagtcattagattgttgggtgggccaggagtcaaagggaaggactggctagatgatcttagggaacactgtcaccaggagatgatggcctgccctccccctgcacccttagaccactccagcacttggctgccaccttcctccagggcccctccttcccatttttccctccatagccagcagcttccctctttctgagttaatatttgtattgctctttgtaatttaacctgcaaaggacagtctaaggttggccggaagctttggcagggacgaggaaggggcagtgcacgctcccccatgattgtgtgtgccgttcggtcggcgttcgagtatacagagccttgtgacatctcacatatgctcgttttttaatttttaactcttctgtttttaattcaagatcagaacgtttccatcactcaaggatccctcatagaaggatcccttttacagccaccgccatttcctccttaacacctggcaaccactaatctgttctccatttctataattttatcatttccagaatgttatagaaatggaatcatatagtatgcaaccattgaggactggcttttttcaccaacatcattctccggagatccatccaggcttgtgtacatcagtagttccttttctttctgagtagtattctgtggtgtgtatgtaccacatttgtttacctgttctcttgttgaagggcatctactgtttccagtttggggctattatgaataaagctgccatgaaacattcatatacagatttttgtatgccaacaagtttttatttctctgggataaatgcccaggagtataattgctggttctgtatagttgcatgtttacctctttaagaaattgccgaaatgtagttgcatgtttagctttttttgtttttgtttttttggttttttttgacactgagtcttgctctgtcacccaggctggagtgcggtggcatgatctcggctcactgcaacctctgcctcccgggctcaagtgattctcatgcttcaacctccaaagtagttgggattacaggcacatgccaccaggcctggctaatttttgtttttttcgtagagacggtgtttcgccatgttgcccaggctggtctcaaactcctgattcaagtgattcgctcgcctcggctttccaaagtgctgggattacaggcataacccactgctcctggcctgtttttgccattctaataggcatgtagtgatatctcattgtggttttaatttgcatttccttaatggctaatgatattgaacatcttttcatgtgcttattgccatctgtatattctccctggtgaaatgtctcttcatgtcttttgcccattttctaattagattgtttgggtattttgaatgttgagttttgagagttctttattttagttactagtcttctgctgaatatgtggtttccaaatactttctccctgtctataactttcctttttatcttcttaacagcgtcttttcaccgaacaagtttttaagttttttgatgaaattcattttatcaattttttccttttatgggtgttctaaaaatgtgttagttttacgtttaagtccatgattcatttcgagttgatttttatgtaagatacgagaattagattgaggttcagtttttttcctacaaatgttcaatttctccagcactatttgttgaaaggactatcctttctcattgaatttcttttgtaccttagtctaaaacccactggacatatttgtgtaggtccattttggagttctctgttccattccattgatctatgtgtctgtccctctaccagtagcatacaatctggactactaagcttgaaatcatgtagattgattcttcccatatattgttcttctttttcaaagttgtcttagcgtgttcaattttcttttcttttcttttctttttttttttttgagtcggagtcttgctctgtcgcccaggctggagtgcaatgggacaatctcggctcactgcaagctccgcctcccgggttcacaccattcccctgcctcagcctcccaagtagctgggactacaggaacccaccaccacggcgggctacttttttttgtattttttagtagagacagggtttcaccatgttagttagccagaatggtcttgatctcctgacctcatggtccacccacctcggcctcccaaagtgctgggattacaggcgtgagccaccgcgcccggccaacgtgtttaattttctttgccctttccatatagattttagaataatcttacttatgactacaaaatatcttgctgggattttgatagaaattcctttacacctgtaaataaatatggggagaactatgttgagtcttcttgattcatgaacgaggtgtggttctgtatttatttgaatttttgatttcttttttcttttcttttttgagacagaattttgctctttttgcccaagctggagtgcagtggcgtgatcttggctcacttcaacctccgcctcctgggttcaagtgatcctcctgcctcagcctctgagtagctgggattacaggcatgcgccaccacgcccagctaattttgtatttttagtagagatgggttttcaccatgttggtcaggctggtcttgaactactgacctcaggtgatccgcccatctcagcctcccaaagtactgagattacaggtgtgagccaccgcgcccggcagatttctttcactagatttttgtagttctcagcatacaaatgttgtatatgttttgttagatttatgcctatttctctttttttgagcacttgtaaatggcattgtatttttaatttcaatgttcgtgtgttccttactagtatacagaaattgattttatatgtctttcttatatcctgtgagctttttgaattcattacttctaggagggttttttgtgtgtgtatgtggtttctttgtagattccttatttctacatagacagtcatattatgtgcaaatagggatagtttttcttccttttctcatctgtatggcttttatttgcttttcttgccttgtcaggactccttttcctacaaatgttcaatttctccagcactatttgatgagataactatcctttctcattgaatttcttttgtaccttagtcttaaacccactggacatatttgtgtaggtccattttggagttctgtgttccattccattgatctatgtgtctgcccctctgccagtagcatacaatgtggactactatagcttgaaatcatgtagatcgattcttaccatattgttttcaaaattgtcttagcgtgttcaattttctttttctttcttttttttttttttttgagacggaatctcgctctgtcacccagactgaagtacgatggcgcaatttcgtcttctaattactgccaggtttgagtagaattccaggttccatgcttggcctggttgacaccagatgatggggggtcccggaaacccactacgcctccactaatgcctccctgcctagaagggacgagagtgccccgtcactcactgcgccccacatggctcctccaacaccaccccaggaagggtgtgaggggcatctggtcactgccaagtgtgggtagaagtctgggctcccacctggtcttcacttacattgtggggtgggggcctccttaccacccagcagggatgaaactgctgcctacccagccttctctggtatagagaacccaccgccaggggtgttggggtgtgcggcccagcctggtgagggtacagctggggctcctgaggcccttgctggcgcaggtgggagtggagctaccatattttctccagtgtttatttcctaaaatcttcctgtcatgccagccttcccctgtcaggtcctttggctaaaggaagcaggctttgggtaaaggaagcaggctttggctaaaggaagcaggctttggggggctttttttgttttcaccattgacatttctgggttgttggtttcttgggctccaggtgtggcatatatgaaacaaaaagaaaacccaggcaacctgggtaacctggcaaaacctcgtctatacaaaaaaatacaaaaagtagccggatgtggtggcatacacctgtagttccagctacttgggaggctgagaagggaggatcacttgagcccaggaggtcaagggcacaatgacctgtgatcatgccactgcactgcagcctgggtgacagagcgagaccctatctcaaaaaagaaaagaaaacccagggaagtcaccagctgtcatccttgggtctcaaggcccctaggcagtctgctttcatctctccatctttcagagtcactttatgtttcttttataggtagtgtccagtgtttttggttgtacgtagtgggaggaatatggaaaggaacatccactgggtcttcccagaagcagaacggtgctgccctttttgctgagtcttgttacttattggctgtaaacgttcttgagatgagcagacctgttctagagttccctatcccccataaggcctgtgtatgactgactggctgttctatatggtgccttgatctcacagagagagaagttctgagaactgtgattaggagagactttaaagagccttctggaacctccgcacaactaagcagtggaggctccctagctccctagcttcctgaagaggctggttggccttgtccctttggtcttcatggagaggttgggagcagaggcagactgcccctgagcccccttggaatataagcctgcaagttgctgtgattggccgaggccttcttgtttcatgacagctacacattctggggagccacgccttgggagcttgtgtcagggtgtccatggcattcaccccatgtctcctgaaacaggaggaccatgacatcatggaagccgatctggacaaagacgaactgatccagccccagctcggagaactctcaggagagaagcttctgaccacggagtacctgggggtaagtgccacacaaagggtggggatcctgaaacagaaaggccagatggacattgatggatttcgtgttttcagtgacacagagggtttagtttggtttgttaccatactgtatttatgagaaggtccatgttagccagtctgctctcagtggccctgaaatgcactgtggccctagctacctgtcacaagtagacaggtgtacggattggggaaagatataactagaaggcatatgccaggggcctttggaacatcagaagatatgcctggccccagtagcaattgcctaccatcccactttttaatttctgcatgccttatgtattggaagggaatactgaggtagacttggaagtccttggcgcagaggtgttggctgaaaccatcatagcccatgaggttacccactgaagcacagtgtggagagagagtgggggctgagcaaggaggggcattccagcagtcaggagtgggagaaaggagaggacccgagaaggccagaaagtgagtagtcactgcgtcttcaggagaactgaagagggttatggaaacagaagggagaggtgtttcaggatggagccagtggtcagtgcaagcatccaagaggcctgtggagtcaccatctgggatgggtccttaagctgacctgtgagagctcccgttggctcggatgctcagccagctccagaaccactggcttacgacccaccagctaaatagggcaggatgtgagtcaggaggaagcagccactcctcaggagaggatagcagtgccagggcccgcagatatctcagagagcaggtaggggggcctggtgggatgctggagtgtaagggtctggaagggaggagcaattgccaggaaccaggaccaattcagactgaaaccctgtgtgggacagctgagcacatagggtagaagagtcactaaaagaggctcctagaactttgaagctggtggttgcttcagtcagttgtttggaccccaaagtcttcctcacggccagcaggttggtgttggagaagaagggtggagccagcgtctcaacagttgactggcacagccagagccttgggaaggagaaagacgatgcatgcaggtggcctgaggctttatgggagcaggtggaagcagaaagtgcctgccaggtcccgttgccacccccaacccagacccttggcacctccccaggacactgggccccctggtcacctggccctcatctcttcctcatcatctgtggaacttcagggattctaggctggagtgcagtgcttggtggtgggacttcaggttggagagagagccacagtccagatcatgtggctttgtaggtcatggcaagggtttgggattttatttacaagagctaggacgccactggaggtgagagcaaggaagtgactcggtttgactcatgttctaacatatccactacattttcactctgctgctttgtgaaggcagggaggtgactgatggaggctggggggcggggaaccaccgcgaaccccttcagggataggggttgctgggcagtacctgccattccttagaacatctcaaggattaaagtagtctaattggctgtggagctgtttacattaggtggagcagggaggtgctcaggaaaggtcagaagtgcagccgtcaaggttccaagttgttgatggaagcctaaggcttgactaggcctctgtcgccctttggaagagcgctggttttgtcagagacgcggctccgtgtgattggtttcacaggcaggcggtgaggaaaacagaggaggcaaattggtggggcttcctcagagggcacgtgttgatacctgttgagaccgcgacgcatgtacccctgaccacactaccgcacagacagacacgcaggcacgtaaacatgagcaaggatggccatttgcagccaggtcagacagaagcttgaatacagcgctcagttaataatctagaggacctctccccggcaaaatgccatgggggaggatcttctgttgatatggtaaacatcttcagtaacaacaaaaaagcaaggtgcagaacgtggtgagactgctagtttaatcatgcagattggtgaggcgcaaaggcacagagctttcaaatcaatcagtaaccccagtttaatggcatctggaaatggtaccatcttaccataatatgcagttctaaacctcctaaatgtttatggatgatccttttactagaaggaaaccatgggtggacatgtgagtactgagaaacacagaaagaatccactgtgaagatgggaagagccagtacaatttggtatttcccgtggctgcagtaacaaagcaccactaactgcagacttaaaacagcagaaatgtattctgtcttcgttttgaaaggcagaaatccaaaatcaaggtatccttagggctcagctcccccgaaggactctatgggaggatccttcttgcctcttccagcctctggtggccccaggccatgcttggcttgtggctgcaacatgccaatccctggcctgccttcacatggccttcccctcttctgtcttttgtaaggacacttgttcccccgggtgacccaggatgagttcttcctctcaagggtccttattacatctacaagggtcttttttccaaataaactcattcacagtttccaggggtcaggacatgggcatagcttctgggggccaccattcagctgaccacaccaggtcaccataggatctcatgaatattttgattagaaaatttaacgtggagcagtaagcgctgaggccggatgcactcccagcactgcccctgttcatgagtcatcccccaccgccctgtcacccggtcttgtgatctgacattgccagcctgccagcctctgtgtgccgggttggggatctcagaagatgggattcccaccttgtcatgcccttgctcttgtggtgcgtgaaaagcctttaaattcacatttttgtcgcgttttgtgtgtgtgccaagctgaggagctctgaccaagatagaagacgtttcactgggaaatatgtgcctgaaagtcatgatccaggccccttgttccgatgtactgggtacattgcagatttttcaagatgactctaaagatgttggcgttttgaaacattctgtcagaaaattgtattcaaaaagctttgagtgaacctgtgccatctgcccaacacagcggaatgccgaagaggcttaagacacagctgttaccgtcaagaagttttcagaaggcaccaaacagataaaactgctcttgctgagtggggtagataacagctggtcagtggccagcaggtgtgatcctgcagggtgagagctagtcccagaccactgaatctgggttaaggatagagtctaggccctaccctatacctcctgaccaaatcccaggaaccaatcatggtgcacgccagtaatttaaaaaccaaccagcagcttgggagtaagggtggaggtgcgactggggcgtccgccagagtgttcggggatgggaggaagctattcccaggatcctggaccagtagcccacctgttccctgcagggccacactgctagtccccaccctcaaagtctacccacagctcctctgctctgcagagcacaggctatgcaaaatgctgaagagcacggcgatctcagaaagctagggacagagaataggtcatgcttccaaggcttgcgggagagtagcgatggccccatgagatgtgttgcttactcgtaattctagtgaagccatgtgctgtgttctgctataggctgtgaacgtcagagttcaagactgctgactttcctcctgcttctcctgcctctagtatttgtgaaatttttagtaccgtgcataccgtgctgagtaatcaacaatgcctctggccgggtgcggtggctgacgcgtgtgattccaagactttgagagacgaggtgggaggatcgcttgagctcaggagttcaggaccagcctgggcaatgtagggaaaccttgtctttcctaaaatttttttaaaaattagccaggtatggtggcacgcacctgtggtcccagctattcaggaggctgaggtgggaggatcacctgagcccaggagatggaggcttcagggagctgtgattgcaccactacattccagccttggagtgcaaaaataaataaataaattattattataaaaataaataaatacaaatacaaatagaaaacaattcttcttaagaagaatgccctgacttaaatagctccatcacctgggttaaaggatataaacatttatgacagaatcatagaatcccagcttttttttttttttaatttcatagtgacctttaacagtaataggcagatctcagattaattcagttcatgccatgggccaagccctgtgctgactgcttcacacaactccatttgactgaatcctcccagcaaacttatggggcatcttccactagtatctgcattttatagaggagggcgctgaggctgagaaaggctgagtcgcttccaggcgtcacctgagcccacctgccttttaccactcagccgggccgccttgcagcagcgctggccgttgtcaggtgagtggattctgtacttgcaagttgagagagctgcgacccgtgtgacatattcgtaataactatatgatctatgttttcgtcacagactcagttttgggggaaatgcctatagtgaatgctaattgctccctttccacacttcctttcccctccatcaagtgagaacccaaattcatttagttttcctaagaatccccgaaagggctggttaaagtgcaggttcctggccccacatccagagaatctgaggctgtggcagtgccccaggagtgtgcgtttttattttcccctaaagtggttctgaagcaggagtctgggccctggagacttggcccatttggacagaactcagggtgttcatggagctgcccccagcctgtcttctgcagcatggcaccgtgcagagctgaggccctcctaggctgggctcagacctgggcgagcccctggagacaggagagggccctgggatcctgctgtacccggtcctgctgtgcctagaggggcagaagcatgaggtggcttgcagcgggccctgagagctcctgcccctctctgctcacaacaaaaaccaaaactagaggagaaaaggcctctgtttccaaatattacttttcgggttttttttcacatatgtctccactttggggcatttcctaatcccttttcagtctattattcctgccctgtgtgactgtaatggttgaagagccattgcctctgcttattaggggatttgttggaactgactcaatgtctatacgtgtgtgtgtatatatatatatatatatatttttttttttttttttttttttttgagacagtgtctcactttgttgtcccagctggagtgcagtggcacaatcttggctcattgcagcctccgcctcccaggttcgaggattctcctgcctcagcctcctgagtagctggaattacaggcgcgcgccaccacgcccggctaatttttgttttttttttttttttttgagacagagtctcgctctgtcgcccaggctggagttcagtggcgggatctcggctcactgcaagctccacctcccgggttcacgccattctcctgcctcagcctcccaagtagctgggactacaggcgcccgccactacgcccggctagtttttgtatttttagtagagacagggtttcaccatgttgatcaggctggtctcgaactcctgacctcgtgagccacctcacccggcctcaatgtctatattcttgtgcatgaaaacacaaccaagtaagcagggaaaaatcccaaaccccaaaatatcttgaatccttttcgtttgccatttgtttcttattcttttttctaattacaaaagaaatgtatgcttattctaaaaagtcaaagtaacagaacgtaaagaccaaccctaagtctacccaaccagaggtaatcactatctcttgttgtctttccttatcagttaggattgggctgagctgcaaatagcagagagtcctaccttatcaatccagctaaaaattcctggcgggtgggggctgtcagagcccaggctcttttcatctcttagcgtggccctgcctgccagaagggcagatttaggctttgtgggtcctccagcttacaagggcttgggaggcgtcctctaaaataatggaatgcaaaattaggtatcaaagcgagtgcttctgtggaatgagaattagaacataaatcatagtgaagttcactttttttttttttttttaaaacagtcttgctctgctgcccaggctggagtgcagtggcgcaatctcggcttactgtagcctccacctcccaggttcatgcaattctcgtgcctcagcctcagcctcccaagaagctgggactacaggcgtatgtgccactacgcctggctaattttggtatcattggtagagatggggtttcaccatgttggccagggtggtctcgaactcctggcctcaagtgatccacctgcctcagcctctcaaagtgttgggattacaggcatgagccacctcgcccggccccaattcacttttttttttttttttttttttgcgacagtgtctcgctctgtcacacaggctggaatgcggtagagcaaacatggctcactgtggcttcaacctcctaggcttaaacgatcttcccacctcagccccccaagtacaaattcaaatgttaaaaattggcagataacacaaacattataaaatctagaaaaataatgtttatattaactagctgcttggcaaacacctcatagtttttcttcatatatcttctgttttatgccctttgattgcttctgtatatggcaaattagtaatgttttacaagcataaacataaaaatgtaatgtttctgtctacatatatgaagatgtttttaatgttttctaccgagaaagaaaaaaagattagcctttcctgtaacatatttgatcaaattttcttaatattgattgattaaaaaactttgttttggcctcacatttagttcatggtaatgccctgtaaatctttttacttaaaaattatatgtataggctgggtgtggtggctcacgcctgtaatcccagcactttgggaggccaaggcgggcagatcacgaggtcaggagttcaagaccagcctggccaacatggtgaaactccgtctctactaaaaatacaaaaattagccaggcgtggtggtgtgcatctgtaatcccagctactcaggaggctgaggcaggagaattgcttgaacctgggaggcagaggttgcagtgagccgagatcgcgccattgcactctagctctgggcgacagagcaagactctgtcttgtgaaaaaaaaaaaaattatatgtatttttaaaagacaaaaatttaaatcaacacctgtagaaaataataaaaaataatacaaaagaaaatgtttatgtaaatttttgttttgttttgttttagagatatgatgtcactctgtcacccaggctggagtgcagttgtgcaatcatagctcactgcacctcaaactcctgggtggcattaagcaatcctcctgcctcagcctctcagagtgctgggataacaggtgtaagccactgtgcatgacccgttttgttattaaatttgagaaaaccatcctcaagtttcttccataaaaacactaggccgggagcagtggctcacgcctgtaatcccaacaccttgggaggccgaggtgggcagatcacctgaattcaagaccagcctggccaacacggtgaaaccgtatctctacttaaaatacaaaaattattcaggcgtggtagcacatgcctgtaatcccagctacttggaaggctaaggcaggagtaatcgcttgaacccaggaggcagaggttgcagcgggccaaaatcacgacattgcactccagcctgggtgacaagagtgaaactctgtctcaaccacaacaacagcaaacactatataggggaggcaaaattttacctttctcccttagcatttttggctgggcctgagaattaaattgatgtaaaacagatacacaggagaaaagcatatacattctataagttttatgtgacatgggagctctcctgcagaaacgaagggaaaagaactggcagaacctaaatgcttttaaactaggttgaacaaagagaggcaatggtggaaaagttaccaaattatatggggaggctaaaggaagacaagaatcatgttacccaggtctgtttgtacagaattctctcagctctgacaacatgtggtttttttcttctggtacccggagagcatctttcacatgggagtttttatcgcttgttttcaggaagaaaagaggaagattagaatgtccttcttgcatcaagcgcctttacctcaaaataatcctaagccaaagtggcttattttggaatggcatattctgccaccccttaactgtaactgggggcatttgaagttttcttgcacactgattattcacaaatactctaacaacatagagaattactagagaccattcctacaccaggacagatagcaatcatttgactatgcatggaaggtactgtgaatcatggaaatttttcccactaaatctaaattaaggccaggctgagtggctcactcctgtaatcccagcactttgggaggctgaggcaagtggatcacctgaggtcaggagttcgagaccagcctggccagcatagtgaaaccccgtctctactaaaaacacaaaaaattagccaggcatggtggcacatgcctgtagtcccagctactcgggaagctgaggcaggagaatcgcttgaacccgggagacggaggttgcagtgagccaagatcgcgccactgtactgccgcctgggcaacagagcaagctccgtctcaaaacaaacaaacaaacaaacaaaaaacaagtgtagggctgggcatggtggctcgtgtgtaatcccagtgctttgggaggctgaggaatgaggatcacttgaggccaggagatcaagaccagcctcagcaacaataggaaggcccgtctctacagattaattagctatggtgacgcatgcctgtagtctcagctacttgggaggctgagacgggaggatcatttgagcctaggagttcaaggcttcagtgagctatgattgcaccactgcactccagcctaggtggcagagcaagaccttgtctaaaaaacctacacatacataaaatgaccatgtgacacattaagtttcattagctctggtaattctgccttgatgtcttcattcacatgcctgttgcctcttgatcatatgatgacgggtacacttcctggcacaaatctgtgatcaactcaggaagaaagccaaatgtgcaggtcagccaaatctgcccctacagtgctttcctgaagctccacttggtgacctccacttaactaactggtcaaaactgggtcctatggcccctagctgcacgggagtctgggaggtgagtatttttaagtagacacattgccgtgccgacaaaatcagttctgttggtcaggaaggagagggtgaatattatgtagactgctaacagtgtctgcctcccctttcagattattttctatgtgtacagagatatagatgattgattgatagatagatagatgatagatagatagatagatagatagatagatagatagagtatacctgtatttttttacagaaattcatactgctttataatgtctttaagtgattcacaaatactcaaaaccaattagtaagaaattttttttacctaaattgacatgttgaccaacttttactactgagtaaattgcattcagctaaataatatgctctttttttattgtgcttaaatatgctgcattttttagtagcagaaccttctttcaaataaataatctccgtctgtaacactgatgaaagccgggttctctgaatgagtacaggtggatgtgaggagcccttgctctcctctctccccagaccccaaagcatttctgcagaactcagtataaacagctctgtctcagcaggttgttggacaagataccctctaagatccttcagcccacaaaggcttctttgcaactgaggggcccgagagtaggctgggtggctcacactgcaagcaaggggaggggaagcccaggccagcaagaacaggctgggaagcagctgcactgccaggccctgcacactgaagccgctccactgagggcctttcttcaggcatttttgcaacagaccaggcagtgctggcccgcaggccagacgcagtttccccatccactggagaggaaaaatgccacccactttaaattattttccaggtttctgtagtttaaggagatgaaataactggcagagtctaaaatattctcgaatacgtgacatgttctgtcatttccaggaagacattgggaggagcgagctcagatgaccgctgacagtggggaagtggaggcagaggactagtcacaggctcgagaaaacccgcatgttgactgtttccccttttccagttgccttcttagtgtttctctgtgggagggctcaggggtcctctggcatgagggacaggaaaaagagaaggcaggagtcaccctggagcaccgtgatgagagcgtgtaaagccgaccctagatcctcctggatcggggaagtggggtggaagggaagttacagtggaagcagacagcagtgttaagtggttgcagtgaaaatatcctgccttggtagatttctttagagacagaaaaggcgacgcaactgcattttagtttttatttacgtggcttagttacattccatttcccccaagaagctgggtgcctcccactttctcactctcccaggctttttccctttcactcttctttccatccctccccacctcctagtcagggcagggtttttttgtttttgtttttgtttgagatgctcttgttgcccaggctggagtgcaatggtgccatctcggctcactgcaacctccacctccctggttcaagtgattctcctgcctcagcctcctgagtcactgggattacaggcatgcaccaccaggcctagctaattttgtatttttagtagagatgggatttctccatgttagtcaggctggtctcgaactcccaacctcaggtgatccacccaccttggcttcccaaagtgctgggattacaggtgtgagccactgtacccggaccagggcaggttttgaccccacctgtcacttccctggctgagaactgtcccagggtccagtgaggctcactgaatcccgtaggcactggccctttttttcttcctctccctgcctaagatactagataaacacaaaggaattttcagcagaaatcaaagatgaaattccaatgttcaagaagtttggttttttgttttttattttatttactttttgttttgaaataattatagattgataggaagttgcaaaagtaacacagacagttcccaggcgcccttcacataatttcccctggtgctaatatcttatgtaatttatagcataataatagcaaaaccaggaagctgacattggtatcatccacagactttattcacatttcactagtttgacagtgatttcctttttaaacagtttttcttaagtattaacataatagtaaccatattacaaaaaattgtggcagaaaaaaatattcttagttctactgtcctgtagagccaccctaatcatgttaaggttcatttctttccaaggtctttttgtgcacttttagcacaattgaaagcattgtttagctggacagagtggcgtgcacttgtaatcccatctactggggaggctaaggcaggaagatcactccactgcactccagcctgggcaacatggcaagacctcgtctcgaggaaaaaaaaaaaagcattctttatgtacattattataacctgatttttatttaatgttttaaataaatatatttctgcataacctgttctttatcattgtacatggctatatgatatatatatcaagtgaatatgccatgttttacttatttactcccctgttactagacattagatcatttcagttttactctataataactttataatgaacaaccttgtttatcttacgctttccatgttttggattcattcactagtatttacactcaaggatgtgtgaacatttttacaactcttgataaaatgccaaattgttttccaagacttgtctcaaatttcaatctctctaattagtgttaatcattaaactagtgttttaaactattgggagcagtggacgggatcgtttttctgtcattcttataatagttgaagaatgccaccttgttttgtaaagttgtagtttctaatttctagtaaagttggtcttttttgtttcttctacttactagtaatactttctattttgtgacatggtggtttgaattctttgcccgattatcaatttagtgttttacttactgatttgtaggagctccttagctatgaaaatgttaacctttaatctgttaaatttgcttcaaatacttcttccaagtttgttgtttgcctgttgatttggtttatttttaacatactgcgcatgtggaaatgttcgtatttttatgaaatcaaatgtccatctttttttcccttctcatttttacaaacccagtccttttcagagatgtgatgagttccagtagatcaaccgctttcttccttttcctagggtttgactttgttttaatttatactgctaaatggtgtgatacacaaaccgttagcaaaaaaagggtttttccccacaatttctgtttacctgaataatttgtgacatgatccttcctcatttatttgcaaagcttcttatcattatagagtagtttattcagtgtattctgcttgacttctaggtcagctctctaatagatatttctccagcccttttttctctttccttccaccagatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagca

SEQ ID NO: 456 - DNA, 529488 bp, Homo sapiens
tactgggtaacttgttaaacacatttattgatttcttgacagtaaccaaacacagtgagtgaccattataaacaagaaaagaaaggcattcgttttgtactttgtgagatctggctgcacctggagagaaaacatacccctttcccaggaacttacaaggcaaagtgcattccttcacgggagcatcacaggggggcatggcagttttgaaacgcaagaagtctgtcgcctgctatctcaggctgaagctcacctcatgtgaatgattgagccatggagtggaattaaagtcatacttgcttagcaaatgcattcctgattgccacaaactcagtaaaaactggctgcaaatgaacaaaacatgtagatgaaggaacaagtgaaatcaaagaatgcagttgcatggagccagggcttagcctgtaaggaaggagaacagaccaaagccagaaaaatgaaattaactcgttaaacacatttattgagctggtaacaataaccaaacacaatgtatgacctttggaaaacaagaaacagcaaatggatcatttctgatcttggcaaatcctactacagatatgtgacaaagagggaaataattccatttccttatagtctgtggtgatatatatacaatgtgtagctcttcaatgtctgtcctttttttctttgtaaattgttgagtaaacagaagaatcataatctagaaataagtgtccttggtcaactttgtcctgctcacctgctaccagcaccctcaaaggatcctaggacactatctgaaattacttgatgcaaagtccgtttgatgccatcagagctgtattttctcctctctcttttggaagaattttgtatgtacaaaggctgaaaagtctcattgggtagatttattagttcaggaaaacggtatcaaaattgaaatcaggttaactggttattttcttctaagacctcttatgaatgagacttttgtttctgaaacttgacttcccatgatggaggttgtaagagtgtgtgtgtgtgtaggtatgtttgcatgtgtttgtatgtatgtgcaagtgcttgtgtgtgtgtttgtgagtatgtgtgagagatgtattcctctgccatggttttgcagacacttttcatgaagaaagggccaatcccaagaatgaatgaggcttgggggaaagaaggagagagaagcaagaagggggacattctaggttacgtcaattcacagttgtagcatttcactgaggtgggattcttcttggctttgttccctacttgaggagccattcatttactgcaaagagagagaaagaaaaaaaaaatcacacatacaacataaaacgaggcatactcaattaatttgcacacagttttagagaattcctccagaggggaagggactgttttgtaaatgcctgcttacttatatgcattccaactactcccttccaattctccatgaccttctaggcctatactgaccaatatggtggccactagctgccatatgtggctactatgaatttaaattaattaaaataaaaaattagttgcatcattgtactagtcacccatccaatgttcaatagccacatatggctagtagctgctgtattgggcagtgcaggatagtcatcaacctatcatgaaaacattcccattaccacagaaagttctagtggatgacactgctctaggctagggatggaaaaacaacagtccacagatctaatccagcacaatacctgtttttataaataaagttttattggaacacagccatacccattcatttagatattatcaatggctgatttcatactacaatgtcagagtgccatagagattttatggcttcaaaacttaacatatttactctctgtcctttatagaaaaagtgtgtagactcctgttgtagaccatatgctctgtttggataggtgtcttatctgtcacccatcacccagctaactgacacatggtaggaacacaatacaggggttttgactaaagagaagaagcaatgaatgagttaggtatttacttttctggtagttccggctggaagggtgtggaaaatatgtagtttgggcatgcaagtgtatctgagagagaaaaaagaagggaacaagggggaagtaggaggaatgaagtggaggatcaaggagtagtggtggaggctgcttctaaaagctgtctggtaataaccacagccctcctatttggggagcatgttattgctacaaagggcttccctatccaggctcttgtttgcttcctttaacaaactgtgaagtagatggcataggaactgtcacgaagaagccaggtctagggggtaaacaatgtggctgggtttgcacagcttgttagaactaggcccagaacttgggtgtcctgatttccagtccagggctctccaagaccccatccttcctccatctttctttccacactgagtgtttaccacaatgattaacagatgtttagtagtaagcagaagggaagagagagagggctgggtgtgcaccacagagttacaggaggcagatgtcaacttaaatgtcccctttagtgggaataataaccatttctagggacatagcactgggcaaagatacactcacaaattaccccattggattctaatggcctgccctttagagtatttgttcatcttctaggggaaagcaggtctttcttccatatacttaaaagctctaatgcttttcactgtcctgttctaacagataaccttgggaacatcagcctttctgggctcttttgaaaaatggcaataaaaagctgtcttgcctgatctacaggggttttaaaggtttgatatatgtgtttaaaggttacatatatatatatctcacatatatcaaacctctacaccttgccatctacctaccgtccatccatccatccatccacttacttacctacctaccaacctacctagatgcattcatacaggtatctgtatcacatatatcaaaactttagaccttcatcaccatgcaaatggagtgtgatggctattgtcatttacagtcatcattcctataatggaagataatgccaggcctttaagaacaggtctaagcagaaagactgagctctagcctagatcctccactctctgagccaccaaacccacctctatactgaagcttctgggctcggttgtttggacagtccttcccctgtaaactgaagttgatattggtgcggatgcagcggttgttgagtggctggacaggcctgaagttgtcactcatgctcagaaagatctgagatggctggttctggctgagcaggcgcaaggaatgcatctgaggagagagaagtggccgtgagatccaaccatcctcttaaatgcactagggaagaaataagaccacagagactctggccaagctaggtggtattggctgtatgaggaaagggctgtataagccccacagagtcccttttttccatgggttcagttgagctgaaggcccattatacctccacacatgaagccagcctttcttctagcttactagcttgtgtatgcctctgaacaagtcacttgcgctctctcaccctcaaatgcagcatccaaaaaaggagcaaatctggttaggtttctctaaggttctttctttctttgatactctttggttcaataattccatgactcccacatggtattacgtggatcatagtgattggtccatgggtcagagctaaactaagctggaccagtttggtttcttttctgtgagactatgagggccaggtggctggactgtttgcagccatgttctgccacaggactgtgaggcaaaagaagacggtctctagcaggagagaagaatgaagtgaatgtgtggtgagaagaggacaacagagagaaagcacttctggggttcccatttcagtgaatttctgatgtcaatttctgattttaaattctctaagatgccctcgtagctctcaaataaatgctttttctaagcttaagtggggagttactgttgcctgtcacccagtgggtcccattcaatacagataggttaaggaacttcaaattgttcaaatggtggtcaggtgggaacacatatcccgtcaaggatattggcttctgcttcctttgctcatctctcctttaatttgttatagactcccacagtcgtagaatgtcagagctggagcaaactcatgtaatttatccccctctcaataaagaagaggagtgttcatttcatagaggtgggtgacaggcctgaagagcacaataagccgtgtagccaagctcacacaggaggacccatctgcctcccatccagttctgatgagtactaactctgtgagatgatccaaaaaaaacactgcacattcaaatatgtgtgcaaaatactacatatcataccacttcctcttgaagactgacacatatattagcatttaagaaggaccccagaaatccttcaacaatggaatctatttaactttttaaaacccaactttttcaaatgcataatgacatcttccattttgcttgcttgctttctgaacactgtagttgtagaatacactctgggaattaatggctatcttttcccactgagacagttgagatgcttctataattagctcaggctaagccttttggatgctggctctttaaacccaggcatatgggttgaatcgtgtacccctgaaattcataagctgaaggtactggtaacccctagttgctcagaatgtgaccttatttggaaatagtcattgcagatggaatgagctaagacaagcttattggggttaggctttaatggaatacagaaggtgcctttataaaaaggggaaatttggacacagagcctcagacacagggagaacaccttataaagatggaggtagaggctgggtgtggtggctcacgcctgtaatcccagcactttgggaggtcgaggcaaatggattacctgaggtcaggagttcaagaccagcctggccaacatgatgaaaccccatctctactaaaagtataaaaattagccgggcgtggtggcacgtgtctgtaatcccagctactcaggaggctgaggcacaagaatcgcttgaacccaggaggtggaagttgcagtgagccaagatcacgccactgcactccagcctgggtgacaagagcgagactccatctcaaaaaagaaaaaaaaaaagatggaggtagagcttggggtggtgcttttaaatgccaaagcacgtcaaagattgtcagcaaaccactagaagctaggggagaggcatggaacagattcttcctcacattccgctgaaggaagcaacgctgctgacaccttgatcttggacttctagtctccagaactgtgaggcgataagtttgtgttagtttaaactacccagtttgtgggactttgttatagtggtcctagtaaactattataataggcactccacatttcagtgatttttttttaacatcattcttctccattagctaaatgaccagagagaaactcacctgcatcctggttatatagacaggtttgttcattatgatccaacttgctgtctcatagcagggtgggatagtcatcgacccatcgtaagtgatgaaactagaggtctctggatatagttcctctatattaagcccctgtagtaaatatgcatcatctagagaaggaaagaagacttaaaaattaggtttcttgagaaagggatggtattgctgacatacatacatacatacatacatatacatatacatatacatacatatatacacacacagatatatatgtatttcttttggaattccagaagactctatctgtcagaacaggctgcagtaacaagcagttgtcccccagatctcggttgttttaagcaataagaatgtatttcttgctcacacacatgatcattccaggttggctgaggcttccctccatgtcattgtccatgctttgggacctagactcttagagcagtaaacacctggacctgtgcggatcacagtgacagaagcgaaagcatggcgaatgtgtgttggttcttaaaacttccatcccagaagtggcacacatcacttgtgctcatgttttggtagccaaagaagtcacatggttaaggctgatgttggggatgcgaggaagcacattccttccacaggatggggccctgagcattggtgagctgtaagcaatgcgttctaccacagggattgtttgaggagtccttgattctagtccctgagatctggactcctaggcattacaggtatcatgagatggacaattaaagcttctagacctgttgaaattcacctggtgaccattctcacttaaaacaacaataagaaaatatttttggatagaaaagtaaatcaggccaaatcctaccatgagattctatggttaagctcaacaactgattattttgtgtgtgtgtgtgtgtgtgtgtgtgtgtgtgtgtgtatttttctctctctcaggtctatgcagatagccttttctcttacaccaatttgaggtattcatacccatatatcttctattactaaatacagtaattcaatggtaaaaatgacataagtacatcacagactatatggaaaaaagaaaaaacaatttcagtcatctaaaactgttactattagcattttggtgtgtttcctgttaatttttttagtcaatgtattggttgtatttttgataaaattgtgtgtattggagttttaaaatatcagttaattgcaatgtatctctcctcttctcccctcttcatgatccttcttcctttcttttagcacgtgattgttctcttctgctggcttcaaaaataccatacttagtattcccatttttctggccattctctctcaggttttgttgctgtctcctgatcttctacctgcttctctcaatgatgcaattccccaaagatcagtccaaggctcccttcttttcttactctatcctctcatctgagagtagctcatctacatccatggcttcacttgccttctgcatcccagtgattccagatctatatctctagaggtatcacatccccaggcataccatgagcacccatcactgtggccagtccaggagacctggagaacacatggcagggtcccaaagcctggctggccgagggatgagactgactctccagccccatggatgcacacatgttctctcgtccatgtgtctaactcccagtgggaaagtactcattcttcaggggttgagggaacctcttcagtttagtattgtgcacatatatggtaaaggaagactttcacatatggctggaacctcacattgactcaataaaatgagtcaggcagatagtaacatcctccactgacaagaaactaaagatcagggaggcaaagtgggctgcccaaggtcacagggctagctggtgactgcaaagtggaaattagaactcagctcttccgacctccagaccaaggtcattttttcattcaacgattattcactagaacctctttgtgctaggcacagtgttaagctctggggacagagcaattaacaagatagatgcagtccttgaccttattctagttggagagatagataacaaatggcaaaataaaaataagtaggctataatgtcacagtaataagtgcaccttgacctgcctgtacttacctactgattaatgctgctaatttattttccttggcaaagatgccctctcctccatttcttcctctagaaattgctcgttcagccttctccaataagaaagagttacctttgccaagggaacttgaatttcagtgttgctttgtcaattaaattgtgaacaaatcaatggagccaatcgtttggaatgatataaatacaatcacaatttgcctactccattcaaagctgcccttcctggcctcctactcccttgatggggtaagggaacccctccagggttccatccaccaaagtctctgaggaagatagcttcaccaagctggatttggagaccaaccctaggaggaaggactttctttcacttttcatttaaatgtttctacctttccgtcaaaacaccaaggaacgaggacatgctcgagagagacacagtgattggaatatggccagcctgggtctgcactatggcctgtttgggcagatgcttccataacaaagccacagtgcccagggcacacacgacgtgagggaccttgggggttacatcaggggccaacccaataagttaacattggatatcagcatttgtctctgactgcctcttaagtccctaagatgtgtcaggcactaagccaggtatagatgagtaggaaataattaagtgaatgcagaaggcatgacagagacaatgacataaatctgcattgggcccagagagaggctgtgagttctgtctggggcgagggtgcggggtactcaggaaggaatgaatcgaggagttgacttgaactgcatctttaacagcaggaggtgatcagtttgtagctgggaatcgggtagggtgtcaaggccactgtagacagagcaatgctagaaaaagagtcaaggaaggagtggtgtgtacttggggacagatggagtgtgaggtgcagggcgatgtggagatggaaggggagggagggctgctgtgagaaatgtggctggtggggtcagcacagaccacaccagaaggtcttcccagcactactgggagtttggacttcatccggaggcaatgcggaaccaccgaagggattgaagccaaggagtagcatgatcacatttgcacttaatgaggcttgctctgatggtggtttggcctgaagattaacatattgaataagagaaggaagcattcagcacatttttgttaaaggtcaatgtgatttgtttaaccaagcttgcacgaggaacacattgggtactctagcatgctgttattattgcattttattttattcggggcggtggggaggagtgaagggggaagtagaaagagaggcattccaggcatgactggagtaaagaaaaggaacatgttttgtttctttgagactgtaaccagcctttgtgctgcagctatatttgtggaaaagattgggggccgaggtatagtgtaggctaggagcaagagtcaaaggttatgctcagggatttatcacacacagcaggtttccaaaacaccgtagtgctgataccccagactccatccactgaggtcctgccaggagatccctctttgtccactccctctccaagatgcaacagtcatcagaggacataggcagcttctgctctcctgacattttcactccccactgtgttccttctgcaaatcttgttaatacttatactctaccttttgccctttttatatcctcacacagcagaacttggaaagacccagagtggagagtgtgagttttagactcacatcgcagttggagtgctgactttgctgctcactctccgtgtgtccttggacccacaggtaaccctctgagcctcagtttctacatttgcaataagcagatggttggagtactttgctcacggggttgtttgaggaataaacaggatcatgcttttcaagcacctagcataaggtgtggtccaggtttgtcacatcctcctaccctgccctggaataactactgctcctctcctcaaggactccctggcttccccagctgggccagtgccctccttttttgctgtatttactgaattagcttgtcaatcattatttgcctatttgactgtccctgctaagctgtgagccttcaggggaagggtttgcatcttgtatctctaagcccccaaatgccagcatgagtccaccacatactgggtgtttagtaaacactgctcgaatgaacaaatgaaatggtttctgctcagcagctctacctgctggcagtgttgggcaaaagcaagggaggaagagacgacatcatttatcagatgaggggaagcatctctgaggctccagtcagcatccttagcttaaatacatgctgcctaccatctcccccctatgtctcacaccctaagacatcagggtgagattgcctgccctgtttccatctccatatgctattaccatgtttccataccaaagactcctctaccttcatatttacattgctgagtcagtgcgcatttaacgtgtaatgtttgttttcatgactcatcatgctgcctcagaggctgccattaaatcagtgtctatcttttaggtattgggatttgaaagccactggctaactttctgcatcttcttttctctctgttgaagcttgctttgtatgtttgataggacagaagcagagggacccaagaaaagaacatgagtaaaacagaagttttcagccctaatgtcaaggcacactggggtgttttcagggctaactaggccaggaactagcttttagtcacaaactatcttgtccttgcagcatccagcagaaaaccattgtttggttcttgtcagcgttatcgtctgggcattatagacagaaagtagactgaggaccaatataccagaagggagattctcctctctaaacttccaaggctctattcatgagtaaggatggcaaagatctagaggaggtcagagttgtttgtgaacaaagatgcaaatttggggtgaagctcagaggccagtgggggagtgttcatgcatgtctctgcttgctttaaggatgtttattggtggaagtgaggacagatgttcaaataaagtttcatgaatagttttgcagagaggtttctctacctatcccctctttctctctctctctctctcagctctctctctctctcctctctctctctctcatatctctatcacctacttacctgtcatatgagaaaatagcttataaagggcaaatcctagatgtcaagtcaagagtcttaattcaagtctgagttctagtggtagctttgccagcaactcattcttccttcatggaaaagaatgtaacctcttacttgaggataccaaacagtcctggaaaattgcatcttcaggtattaaacattctatggatccgaaaccatctttcaacataagcaagcttgttagccaaatttatcttaggtaggtcaaatttttatatgagagtgttgtaattttgtatgtgttggctgtatctttatagtaaaggaggaccccttggatcttgaataatcaataagtgtagaatatatgtgtgtattttatcacccaattttattatttcaaatgactgcagaagttgacagctgaacctttggttttttgacatgttcttgatgaacctgtgatttatcttatactgagttcttagtcgtggttacaactcccaagctgactttttctttttgtaggagacgtacactatgataaaatgcctaggaccacttgggggagtcgggggaaactttccctcagtctgaacttttttttttcagtctgcatttaacaggcagcctctgttaaatgcattgtgcttactcatgtggaccactgatgagatttaatattgcccggcttcctgcttatgaagttcccatttgaagagaactattccaatgagaacaaggcacggtagtttcagagatcaatactggacttgttcctgatcaatatggaactatttggcaattttctcatatagaatgacatttcctcttgtaatctgaggcaaattcaactgaaatgaaaaaaggcaattactaaagaatgaagtaatatgatattttgttttacacaaacaataaatgataaaagggacctctgagaattggattcgtggaggtaagctgctcctgttctgttccttgctgacgtgagtaactacttagattgcaacatggaaagtggtgtgctgcgttttgcattctgtgaaagcatttccaaagccgttcctttgaaatgaaagtacaagttcaattaagcatagagaaaggcaccaggagcaatatgcttaaactccttggtgatatttcgtcacatttaacaccacgtccctctgaggagcggcgcataaaacacttcccaaagaactgagaagtataaggcagttccaagttgatctgtccttgcctacacatgcatcttttagctgaatagaagatctgggggttgggggaagtaaagcaaagttataaacaggtaagactgaaaaagatgctttaaagggcttgtgccacgtgtcaaagcgctgaatctgaaagctctcctccagatgccttcagtggtgtggttttatttccttagaggaaatacattaggacaatagccatatctttttttttccttattttttatttgagatggagtcttgctctgtcgcccaggctggagtgcagtggcatgatcttggctcactgtaacctccgcctcccaagtttcagtgattgtcctgcctcagcctcccgagtagctgggattataggtgcccaccaccatgcccagctaatttttgtatttttggtacagacagggtttcaccatggtggccaggctcgtcttgaactcctgacttcaggtgatctgcccatctcagcctcccaaagtgctgggattataagtgtgagtcaacacgcccagccaccatacctttttaaatttgaaatttgtgatcgtttggattcttattggactaaatgaatgggggcatgcgacactgaaggagaatgaagctaccaaaataatactgtcctaagatgttagaggaaagtgttttatatgcagtgttctaataactgttccctcttacccacttaagaagcctctttgcacttcattggtcactagtttagccacttgaaaacagcataaaatctctttttaaaaaataatgctggcttaatgaaattgggtagataataaaataagaatactactttttatttaattgggattctgttaattaatgccaattaattaacacaagaaaaatggagggatattagccttattccaatacactacgttaaaaaattaaaatacttcaagtaaattaccaatatctcctccagaaaatccattcggaaaatctatttttcaatgtcatgattttagtcttaacccccagtctgttgaaggggaatttgactttaataaaatgggttttctttagaagactttctaaattcagcccgaatttagttcaggctagtttttttcattgtcagtcccagttagagtgttttataagtttcactcagacatatgaaatctaagcttgcaaggaaagtaaagtagtagaatctcattaaatcatcaccatccactgcatggattcaagcacaggagcggtatttcatttaaaacaagcaaattctgttgactctgtgtcctgtattgcatttaccttcaacataatttttatttggcatcatagcaacctgcctcctcccctgagggaagctggatttgatagccaggtaccttaagacaacttagaaatacacgttcattttacacctagtttataccactcattgttcaggcatttgactcattaccttgtttgattctcatgccaaccatctcaacgtcagcattaatatcttcctcttacagatcggggaggtgtttagaagcttgcttaaagtcaggcaacaaaaggaagtggtagagccaggataggagcccagatctctcttcactagaacacactgcctcccatgggtgtggtgcctttaccagcatggcatttagcctccaaaattcccaatcctcttggcgagattctccctctttcctccttgtatgaatttcctggcattgattttttttgtaactggctcaaaagaatgattttgcacagttccccccctttttttttttcctggtcattcattctgtgcccaatcctacaaaccgggcaaatggactgtgtctcttccagctgccatgttgtgatttcaccccgctgcctccatgtgtgcagcagctccctgcaccacctcagtttgctgatgaggcagccacacgggagcctcttccagggtgggattttaaagatatctttagaagtgattttcaatcctaagtcatggagatttgagttgctctttcaaaagtgaggacatgtcccgcctctcttctctatttattcttactctcaggatttcaccaacgtttaaacgccatctggatgccaacgtcttccacatttatatcttcagttctccctcctgaaatccagactcatatatccaactgcctactccacacctcttcttgggtaccttataaacatctcaagctgaacatgttcaaaatttctgatttccttcccacccacggatacgcttcatccacagtctccccatctcagtggatgaaaatgtcttctttccagttgctcaggctaaaagtcttacagtcatccctcactcccctctttctctcacataaaacatcagatatattatcagatatatcagtacatttcttggcttttttttttttttttttgacagaatcttgctttgttgcccaggctggagtgcaatggtacgatctcagctcactgccacctccgcctcccgggttcaagtgattctcctgcctcagcctcccaagtagctggaattacaggcgcgcgccacaatcccagctaatttttgtatttttagtggagatggggtctcaccatgttggtcaggctggtctcgaactcctgacctcgtgatccacctgcctcggcctcccaaagtgctgggattacaggtgtgagccactgtgcccggcctcttggctttttctttaaaatatatccaattatttctcaccatctccctgccaatccccatcagcccggtcatggtcagtgccatcgtctcattatttgggttgctgcaatcctcttctattgtggactctgccccttgtagtctattctcaaccaagcaatgaggcgatccttttgtcaacagatgatgtcactctgcttaaattcctagattgactttttgttacaatgaccttcaaggggcagattttcagaagactgaccccctctagaattaatctctgtgccttctctggtgactatatatgtcagtaatggcaatgtcactgtgtccctctgaatgactgatttccactggaggtaccatgttcagggccaggcaggagttggagagagcttaggtcaggatgtacttgaactgccaaagttcccatcagttctgtggttagtatatgtccctttcaagtggaggcacatgcaaatagcaaaaagatgcttcttcaaactgaaccaaagttggaattaagagaaaaacatgctgacaagtttcatggaatgtgaaaacatcttcactgcaattagttttaagaccctggagctaagctttccttcctccttagggagaaagcatgataggaaggaaaagcagaggaaacagtacccaggaagacctgtatttggatacttgctcttctactatggaagaatatttttcaggaaatgttcacttcttcctcatcttcatctccttggcaggattttcatgttgagcttggccatatggcttgctttggcttgtggaagtggacagagtgagtgtgtgagtttcatgactaggccttaagtcacatcacttatttcttccctctaccatgagaactacttgccctggatatcatcttgatcctagaacaatgagagtcacgtggagctgagctgcttcagctcacttgcagacctgtagctggaagcagagccacccctaccaacccaaggagggagcaataagaaatcaatgcttatcattgaatgcttgtttattacgcagaagttgctgactgatacagccattaaatgtgtgtcattggtcaaatgacttcacctcttgaagccttgatttttcccatctgtaaactggggatggcaatcataccgctctgaaggacttcgtgagcactaggtaaggagcctgtatgtaaagcatagaccttggtgtgtggaaagtgctcagtaagcatcatctccatattcctggggctcagcacgttgcagagtggatactgcatctaaatgagcagagcaaattgaagctatgctggggtgcagttctgggtagcaacagtagaatgggcaggggtggaggttaggtgtccctcagtagcatggtagaaatggtggggtggggggttgatttctgtctctcgaacatttagaaggacagaagcaggataccctgatagggccccctgagttttcttcatcttaacctgaatttatgggccagtgctggcctaacctgctgcctgttggaaagcctcgggagggacttccagtcttatgtttcccacccactggctgtgttctagtgaatgactcctactccagactcccctgcctgccactgggctaaccttctggctgccctagggacaaaagagagctgtggttttctgctgcgcaaatcaattcatttctgccgcagtgtcctgggcaaagcagtgtcagggtcattctcatgaatcggccatcattattcctgcagtgctgctcccttcaggtatgtgacaaaggtcactacagaggacacctcaattactccctgctgaattataggagcacaaaattcctgttattagggggcctaaatcagctatctttccccatgcaggccaggatctctttatcttgctttggctcccctttcttttccctgggccctgagaggtgtagagtatgggggtcagaaggagagggtgctcctgctgtcttctatttgcatttctaggaatgtgtcttcagaggtgaaaagggtgtttaaatgtctgcctgccttctgcataaacaccttaacatggctcaagatccggctccagaacatctttcttgccactccctctgccccgtcacagctcctgaaagaggccattcatccttctattcacccaggccatcaccaatgcttattgggcgtgcctcgtcttaggcactgagacgaagagctgatgaagacagagttcctccctctgaactcttcaccggccttcagtgctctccaggttttgtgcatgtggctccccacacttggaatgcttttccttccctccctccctttcttcctttcctcccttccatctgtcttttccttcttccctgcctccccttcctctccctcccctctcttgctcctcccttggtggcacaagccacatcacttaatattaatcagaccagtgctgggggatgggtggtggggtggggaggaaagtccctctaatgattgactctgcaactggtaatctgttagactgtgtgttggggcttaatgtgtgatttcatgcattttcacggtctctaaattgcaaatccaagattatttgaaaacattttatttaattttcatgcttttttcatcaaaaaagttaaaagaataataatcttttatgggcagttataaatgtgctatttacacacaagacagaaatatctcccttagctgagcaatctaagtgtgtgcttagagaggactccataagaatactaatgagaaaaggcagaatatgcttggagacaacctaattcattcttctgggcaatgtctctctaggtggagcgggattctccaggttcattcctcagccctaccagtctcccagcctctgcagatgggagggacttggcagtgagcacgtggtagttgtagggctgctgtctgggccatctttacatccctggagcttcgcttggtgcctgtcatggggcaggcatgcaggaaatgtttgtcgaataagtgagtaaacggctgagtgaagcattctccatactctcccttggcagtccaatgtgagagctgtacacattcatttttttttcttcacatcaccattggagagagaagcagcagacacagctgagctcctggcttggtgaagggcatgccaaggggatgtgggtgcttggatgtttgccaactgtttttcacttttgtgagaatcattatttacctattgcttgattcagaatcccagacctagaaggactttagaaacttgaagttcaacttttttactttataagatgaatgacagagtcaaagtgaggaaactccttgatgaaggacaaagccaggacttgaatcccagtatcctactcgctcctaattaggtaaagacaatcttttttcctcatattatttctttcatctatgggtgtgtgctgtctcacccaacttttcccaaatcctgcaccttctgggattgctggagatgacagcagcatctttttccttcctccttcaactttgcactgttctctcttttctgcataatgagtctggggataaaacactctggaaacccaaggaaactggacagagtcctctacatccatgggccacacatgtggctgaagagagatgctatcctgtctctgcctggaaaggagacccagccacacacagagaaatggtctagccgagggcttctgtaaatgttgcgattggatccatagtacctgatgagggctttctcaatcccgtaattggcaaagccccaactgtgaccagctgacacggtggagcgtgtcagccagcagagtcccctggctcattaccaatctatgggataacgatgaccaccatagtcataatcattatcaccttaggcatggatgacaaaggcaccctagggacttctgcttgaaatgagctgcttcttagccaaaccctaatctccagagtgactttctacagaactgcaggatcatgaaactgaaaagggcccatggagatcatcagttctggcttcccgccttcaggcaggtctaacctttatagaatagttgctgtggaggaaattgaaccaaacttacttttatatgttattcttgtgatagtatctctgttgagcattcgattaagaaatgggtttgatgaatcagaaacctggaggagaaaagaaaatattaatgactgggcatcactcttgcaggacaaacatctccccgtgacattcacttattcattcatagttactgagtatctaccatgagccaaacacaatgacagctgcaaattcagagagcaaagccagagtccctattctcaaggacagcccagtctagagaggaagacaggtaagtgaacaaactgttctcatatagtgtgaagagtgctatgattgagtcattggtgtaatgatgttggaggaagaccagccaccacctgagaatctaagtcatgagtctgagaggatgggtagaagttaacaaagcgttctggtgatagagtgtgaaaagggatgaaaggcaaggaaaagcatttcatacagaaaatctttacatacacggacatggggaagtgagaaccaggcatgctcatgcaaagacttcagtgtacttggagctgagggtatggggaaggataggaagtgagcctagaaagattggcaggggccagatcatgtcaggcttttaagcaaggtagggactgacatgttaggaaggggaaattcatctacgtagagggtgagacataaagagtacccagaatagaggtataaggaaatggaaaaaaaaaaaaactgaaaagtatcactgctcattattgcatgaattgagtatatcataagccatgtaattcaatcaaccaaccatccatccatccagccagccagtcagccagccagccagccagccacccacccaacaaataaatatttgcagagggtctattatgggccaaacattgtaccagatgttcagggatcagttcccattttatgcctatgcccttatagcttcaaattcctctgttgggagaagaaaccaggtttccaggggcttcagcagggaaccatcattgatgagactgtgatgtggccctacataagaaaagggttttcttaaaaacacctgtttactcagccttttctggggtaccattgttcatcctagtcatttctctcctaccttgcttagctctgctctgtaatttatgtctcagtggctaatcggatgttgtgacacatcaacattttaaatctgatttatctgagggttggaaaaattgcagcagatgattattattattagataagcaacaggtaattttagcttggagaaagcacagactgtttattttccctccatctgtctccctttttgcggtttcctggctgtgttgtggtgagacacacaccaaagggagcttggtgagtgacaatgcccagtggaggtaaaagtccatccctaaatagaaaaagtcccaaattgaatactgctgctcccctcagtgctatattcaacatctactttgacatcctcttcagccatttaaaagatagcttgaagcctgctcctggtgctgatgcaccccatgaaagaaagatggctaggaatatattgtcgtggcaggtaaggaatctgttatgtaccttacttcctgggtgccttgagctcctggtacctggtgagtctggtcagcccttgcgttgggagcagaccattttgagctgattaaaaataattgaaaaatttccaaagtgcacacagatgatttgtgggctctagtgtgttggctgcgtgggtgagaggataaaatatgtacttggtataagtgagcttaagtgggaagttaatggtgtgtgattgagcagcaattacagccaaatctcagttccctgtggtcacagcaagggtgggggatttgtggaggacagagataaataaaactcatagataagcaagtatctccttttagagagtaactccagcttttctacggctcagcttttagccagggtgataactctaggactaaactaccaggatgtggggcttgtcatatcccactcctgcccaccctgctgggaagggaaggcagagagttcagaaggaggggaggacaactacaagaggctgtgcacccttagggaccaagagctttgttcatcttacttctggataccagtgcctagcagagggctggcctgtagtacctcatgctccatcagagttttgagatgagtgaatggtcagtcacagcttaaataactcatggtggagttgattttctgggagttgattatatggagggaagacagaaatgttgtggcttattttgagatctagcaagaaagtttcaggtctgctcagggaaagaatggcttcatccctaggagctaaactgacctgagaagatgcaggagctagttattatcccttcactgacctcagggtctacagcctaagtttctttcaacagcctgtgggcaagcaactaggacttgcaaaccccagctgctagtcaccagctcggtaggaatgaacatttctgtaggagcttgtgaaacacaccagtaatttgttgttggcttcccagtgtatccgtcactctgtcagctgtcatgtgcctgtgcctccagaatgacagtcactgactcaagttttcagacacatgaggtaaagtcaggaccaaggccgagacactctccaaaggacaggaattgctggggcaggcaggatttgtgctgggaaagtcatagggggaagtgagctcctggacacacatgacaatattgtgacctatctacggcttcacagtgagtgcagcctaggttgaatgtacaaattggttatcaatgccataatcagggcttgattaagagatacaggaatttgccctgtgcttatgagtagcatggggttgtggggagtgtgggaagaatgttttaaaatgtcatgtactcccttcttgccctcacttgctctctcccagctctattggagaggcatagaatgagtaagccattctttcatgagtattaaagtcagggaagacttggatcctctcctggctgggctgttataagcgacatgaacttgggtgaaatcccaaaggttctctgaataattttactcatctgtaagatacaacacgaatgttcaacctctgagtttattactaaacaacaaaatagatgtaaaatacatatcatagtgtctggcattcagaaatctactgtttattattccagggtttgtgatgatgccaggagataccattagaatctgtgctgggaccagtttcctttgagatgtcatgtcaagtatcacaaaggcatgaaagcctaaaaatatgcttccctggccaaatgtcccttcctctctttgttaatgacaaaccagaggaggttgaggttagtggccagggatagcaacatgccatggatgccccatccagcccctgcccagtgcataggtctgccctgatctgaccaaggggagggtgaggaagttaggagggggcatggcatggatgaccagggagggtgaagtgcctatggcacggggtaattcttttgtgggggcggggagagggatcagtgccccaggtgcccattcttctgagtaataatgatgtcatcatgacagccctgttaaaattccctggtggcagttttgatctattgatcatctccatcagattcccaattccgattggggcactttctctaatgatctggccaaaacatccccaggggctagcatggtgactgctaatgtttggaactgccacacattgcttttttttaatttttatttttctaattagaaaagcaatttctttttttattaaaaaatttgcatacctgcttctctctacatctgctaaaatgttaaaggtaattagtatttttttttaaacaaattagaatgtgattggttggagattttatgttgtcgttgttgactgttagggagatgtggagtttcctcaaaatgtcataaagtcagtgtgggtaatcttattaccagggaggcttatgaaggaacgggagagcgagagagaaagatgatgctcagagcaattgtgaggaagctggaaggagctatttagtgcagtgcctggaggggagagacatctcacttcttcctatgtttacaaggggcagctgaatggtgaacaggactttaatcctgtggggcattagtgagccacccacccttctagtattatatccttctgatttcactgcattaggtgggtcctaaagcctgtccctggatctagccccctttttctttctaggacagaagctgcttgaatcctcaggcccagatgctctgaaatggagattatcatttttgcatctcactgcagggggcctcatttttcataaatctcatgtatataaaaggcaccatcccatagttttcttaggcatggatagcaccccttttaatatttctaactccaacagagaccgtaaattggtattctgattgaggtggggatggtgagaagaatgaaggaatgcaagagacttacttttataaatatagaaactaccaccaatccatttggactctttgcagcttctgtgacattcgtatatagctcatggttatagtggatgagctgcacctggcaggagggaaaaacaagaatcagaacaataatccaacattaaaaggtatgaggcatagcacctgcccctacataagggtgaactgcaaagtatattgaggaacaatttggaagacaattttaattgaagggatttcagagggatgtgtgtgcatatgtgtgtaaaatgcatgtacacgcacacaaaaatacccatacatatttgcaaatgttttctggtaacaagcatgcttttcataagctcagagcccatctggctctggctccatcccaggacatttcccctaaagcgtgtgtaaagtgaattttccttattaggaacggaactgccctgtaggggtggatgttgtgtccctgctgcaccaccaacagctgccactggcagccagtaaatcttccttgcagcctcggagcaaacagggagctgttaggtcctgagtcagccatgactgggatgaaactggccagcctgcaagatgcagtagtagctgatggatcaggcttctgatgcaccagcctgtcccggtcatctggttgtgtaggactttatttcctcctcattcaataaggatcagtccacctgttgagcctttttcctgttacttaatttttttaaattcatttttaaaaatcgtgtataaacatacatatatgttcaaacagatgctccagcaatttttagccacatgatcaagttaccccacatcactgggatcaattgtttcctctgaaaaatggatatgatgatctttccttaaaattcatcatctcagggctgtgattttaaaacagttttttcttaacagtatggaagcctaattttttttttttttttaagttggagtctcgctctgtcacccaggctggagtgcagtggcgcgatttcagctcactgcaacctccgcctcccaggttcaagtgattgtcctgcctcagccttccaagtagctaggactacaggcgcatgtcaccacgccaggctaattttttgtatttttagtagagacggggtttcaccatgttacccaggatggtctccatctcctgacctcgtgatccacccgccttggcctcccaaagtgctgggattacaggtgtgagccactgcgcccggccagaagcataattttttaacaaattaaaatatagaagtaaaaaacgtgatgccccccccaccacctctttctaattctagtccatgctatacatacaactattaacagtttagtgtacatccttgtggttacttgttttgtgcttataagtcacacaaacacacatagcgtataaaaaataataaattccctagtccacagtaactgttaaaaaaacagaaagggatgattaataattatgattctgaacttgattttttaaaatttaaaagtagtttgtagctatctttctaagccaatgcatatagatctccccaagtcttccaaataactatagaattctcagttgcacaaacacccataacatatttaaccatcttctcgctggctttcgtgttgtttccatttttttgtctcttataaacaatgtcacagcaagcacatcatatatctttctgtaatggtgttagcattttccacaggctgatttgagaatccaataagatagtgcatgtagaagtgatttgtgactctgaaagtgtaagagagtactcattattgccaatatcttgaattgcattaaaaaaggtgaagttttagaagttgagaaatgtgatgatcaaaaaagatgcttttccttgaactttgagaaaaagaaaccatatctaacccagtggtttgctaccttcactgtgcatccagatcacctgggtgcttttaaagcccacctgtgcctgtctatgccttctcacattctgatttaattgatttgggatgatacttgtattcatcaaaagcttaccagctagagggaagttggacttcagaacaagtggaacataatcaatgaacattaatatcccatcaatgcctagtcagatggacagtaccttgaatctgagaatatcctgagcctcctgaggtgtagaggaacttctcatgaagagagcacatgttactgctgctcttgaaatatcctatttgcttattgctttttcacctatgagttttgccagtggagatggatgactctatagtagctactctgccatcagaaaggcaaccgcaggccaggcgttgctctgcctccgcaggacttttaatcccccctcccttgtacccccacacaaccaggactttctgcaggtggagaaatgttgccaggtggtggaagaaccagggactggggggttctcacacactcagcacacctcccttccagtgctgagtaagcttctaatgagaacaaaacacaccctgccatctgctaacttcttcccactgatacaggtgaccaacaaaactgccaggggatgtgccagtgcttccagacatgccttgaagttaaagcatgttctgaacagaggagggacatgaaaggcaatccagtggagtgatccttctgtccagcttgcaaggcagaaaaaggcaggaagaagtctcctgggccatgggctgcctctcagggtggggttcttttgggagccaggaactgtaagaaaggagctggcaagtacagggctgaggctgtgctttaagcttgagttaacacatttaaaactttgatctgaagtcatgcctcctctctgttccaaggtgagttggctaggattctgatatcaggagctttggtttctattagtagttgttgatggactgtctattgtgttaggttgaaccacatgaaattgatcttttgctttacaaaactggtgaatttatagttaatacattctagaaataaagctattttgaatatgagttttgagcattttctttctgacccccagtcagatgttaataagatgacagtgtgcgctctagggatcagcagcagccacagcatctaggagcttgttagaaatgcagaatcgggagccccatcccaggtctcctgaatcaagatctgcattttctcaaattcctagtgatttggatgcacgctaaagtttcagaagtgctgctatagcagatactgttggctggtgagcagagtcctgttttgtctggctgtttaccccttctccacttcaatttgggtgggttaaggagcacatgcatcacctatgttggaaaacaggctgagtccagatcataggacccctggaatgtcagcaatagaaaggctttgagcaggggaatgagataatcagcatggactgtaagagggtagattggagccaggagaaaatagaggtggaggttggggggtatttaatttcagatgatggttattaaggcagagatgtgctctataggcctttgcagtttacagaatgtgtatgtttgtgtgctgaagaggcaccaggagatttccccaggcaacagaacatctaggagcaacagaagagcacaggagacagcttgacagtcaccaggctttttgttctcagctgtaagaacacagtttgggcatcaaagataacctgggacctgtatcagttcatgcatgaacagcaggtcttaaccatgaaaaagtgctgcttcctttctactgccttccaggtctttgttggtggtgatcacagttcctgcagctgttgcctttgctcttccctagccaggcacaataatgctaacccaatacccactaaccactcacaatatgcatgggtccaggtgggtctggagaaaagcagggttcactgcttctcctaccatgactttgggcttggggagcagcaatgtgcaaaccacatcctgctagggacagagtatcagattggcagatgggttctgaaagtgatgcctgtggatggatttctttttgccatgtataggtaacacttttaaatctcaaccatataaagtctgaattttgaataatttagatgggccctaagctataccttaactgagccccaactttaaggcttatgcagagtaatcacagtgtctgatgtgaaacagatgatcaataagtgattgttcaactgtctgagcaagtgcatgatttgactaagactgcagggacaatgagagcaaactcttcgggggctaatgatgacatgctaattaaacaccaagttcaagttcaagaatttaagctattcattaaagagatgccttgagggcttctgctagtttagttggcattaccatgtgaaagggttaaacctggattcctggaaattatttaataatcttgattttttaaattagttttaggcgagtatcctcctagagaagcttcctggaaatgcaagactgagaaatggcaggcagtcttccagggagaatactaccagtcttgtcatgatgctcccacatggctggtgccatgatgcagtgcattctctatatctaagaagtcctccatgatctgatgtgacttgacttctcatttcagaaaggccacctcacctcaatcctttacatgggcctggaattcatttgttcaaaaaatctttgagggccaactatgtgctgaggtcaattggaataagactgagaaggtctttgtcctcctagagatagtttcagatggtggcaaagatagctttgaaggaaacaaaacaagattttgacttacttacagattgaaaggtagtagtggaaagaatgggggcgaggatgcagaagtgggggcaacattctgtagtatggttggtgaaaagtctttgggtaggctaacatttgagctgaatcctgatgaccaggagccaggtatgggaagatcagagggaagcatatcacttgtagagaacacggccaatgcaaagagcctgagatagggacaagcggctaggaatggctgggaaaggatgaaggtggctcaagatgggaccagttcatgcaaggctttgtagaccatggtgaggagctttgattttattccaaacacaataggaagtcacaggtgttaaataagaaaccaattgatctgatgtgcatttttgaaagatctctctggtgtggaggagggcaaagtggggactgaggaagccttgcctacccttctttacctcatagttcagctgggattgtgcccaattcctgcgactatttgagttcacattcaagcacatgctattttgcaactattctctttgtgtcttaccttctccaggacaccttccatgaaacactgtctctgaacaccaagtgcagctcccttctgctctcatgatgctctcacccaggaggcaaatttgtgatggttaattttatatggcaacttgactgggcaaagggatgcccagacagcaggaaaaacattatttctgggtgtgcctgtgagggtgcttctagaagatattagcatttgaatcagtaggctgagtaaagaagatctggccttatcagcgagggtgggcaacatccaatctattgcaggtatgaatagaataaaaaggtggaggattctctcttccttcagctggggcatccctctttctttgcccctggacatcagagctcctggttcttgggccttcagattttagactctgggacttacactagcgaccacctctctccctgtggtttgggattggggattacaccatcagcacctcctggttctccagcttgcagactgcacattgtgggacttcttggcttccataattgtgagccaattcccacaataaatctcctcttatatatctatgtatatagcctactgattctgtttgtctggagaaccctgactaatcaaaattcaaaatactttgcaaccaaaatgggatgggtaccgggtgatcagaacagatgtaaaccatagacgcccagtacagtcacatgagtgctgaatatcattgttaaagttagtcatcatcaccactttggatgatcattaccaacatttgtcgaacacctctttgtgtgagagacgatgccagcagaaacaactcatttaattcttgaaaacttctatgagttagtgccattatttccatttgagtcatggggacaccaagcctctgagagatagtggcagaggtgggattgtgcccagttcctgtgactatttgagttcatactcaagcacatgctattttgaaactattctctttgagtctgtgtctacttttgggtaaacatctcaagggcatggatatccatcatcacatccctggtgatgggatttggctcagaggagatgttggcaagcatttgctgaatgaataccaattctgcatctcatagaatcttagaaggggtcttagagaaaatcaaggtcttagttctcagcccatgacttttaaaaatgaagaaaatgaggatcaaagaggagctatgtcttgcccatgattatacagtcattcatagatccaatcattcaacatgtgtttattgaacaactcctaagtaagggagggtgatatgacgagaaattgtattggaaggcaggagaagaccatggagagcttggcaggccaaggtagggggtcttgattccatcctaagggtaacgaagaatttcacttatgtcctagaattttcttaggaccagaggcaaagtttctcctatgcacttaattgaagtggaagcctgaaaaccattggcctttggtgaccggtaactcagctttcaagctaacagacaagtactcctctgtgttaaataagcagacctgctgcaagaggcttccaagttgacacaagccacacttgtcataggttaagctgggagcagcttcagttgcacaggtctcagagttttcattttgtggtagcaaggtgatgcactagtgcatgccgggggctgctcactcacccctcatgcctcaggagggcaacaggctgtgttctcagaccttagatcacctttctcagcgtgatgctccattagcagaagcccttttgtgagcgcaaaagagcagccttggaacagaagaccacacgtggcgttcacagtgacaatgctatcaccttacccctgcttaaacacctcagtggcttccccttgcctgtaacataaagatgcacatctggggcccctggcttttctaaccatgtgtccttgttttctgtgctctgctcagtgtctttctttcagcctcccttatatactgggcttcctcctttcctagaacacatgcttattctgtttcttatgcttcccttcccttaaacagagaagggagggaataaacttccctcccttcactgtttgactcctacttatgaactcctttgtatctcagctcaagggtcacctgttgagggagatccccatgatccactgtcatggcactctgtacttttcaaaatacatatcacagttttagcttgacattcgttgtgtgactgatgaatgctcacctctttccctagactgactttaggcttcatccaggcatgggctctatcttattggcccctgtgacatctcctatacctggtacatattaactgtatcaaggcagaaataaataattgttaatgaatgaagcaatgcaggctgtctattgtacaatgaagtgtgatgtcccaagggacagagagaacaaggcgcttggctgaactggttaaagaacagtctggaattccaaaggttatctctaatgggaaccaagacactgagtatcacattgggctgcgtgggttgcaaagcctggtttcacccttgggtccccttacatgagcaagtctctcatctataagagggatagtaataattcataactaatactcatagcactgtgtgatgattctataaaaccgaatataaaaaagcacttagcccaaggcctggcatgcagtaaccattccatagtaagctactattgttgttgttatgcaatatttattatgcaagcaatagataatacagccttcagcttctgcagaaataggggttaggtatgtgcaggtctcctttgtggatccgacattgagtctgttctcccaaggaaacttgaggaaggtgtcacctattggggagcacccactgtgttccagacactgaatgaggcgagaacttttaaagagaaatgcattccgaatggctcatactgtaattcaggggtcagcagactttttcctgtaaagattcagatagtaaatatatttttctatgccaactgtatagtacctgtcacaactactcaattctgcttttataatatgaaagcagtcatggacaaaatataaaagaatgggcgtggctgggttccagtaaagctacagaaacacagcgtaggctagatttggtctgtgactgtagttttctgaccgctgctagtttaaatttgggagatgaataaagaacttccagtcatatattttccagtaagtgttctatacagataggaaaatacatgttgagagaacctaagcattaagctctccctttcctttaaatgatgatgattactattgttacctttatatagtcctttaaacttttcaaggcatattcaactcaaatgagctgaattctagtcaacgtataggtcccaaatgcccaccctatgccagatcccagaagtccagagatgaatgctgtatattccatagcctaaaacagctcacccatattaccacatttgttcctaaaataaataggtgaagtgaagacattaaggcacagagaggttaagcacctcttctgaggtcacacagacaaaaagtgacagtgactattcatttcacattagcatatgcaaatagtttctttctacaggaaagtaaagagaaaaggaaaggtgttctgtatttgaggggagatcacatttcagcagcttttgctggaacaactataagctagaacttatttatagaaagtcattaacaagtttgtcttcatgcataagagcacacacagtctgcagagaagaacacagtttgatgtttaccagccaccacattctcaccctaaggtttggtaactatcatgggtctgtccggtgatgagattttctgcattgtaggctatggaatgcaattatggctaaaaataaaaataattttccatagtttcattgacagaagatccccaaatgtggtctggctatcataccaacctagaaaaccagcatggaatgtaattattttcccccaaaagataacacaacttggattttaaagcatgtttttcatcaagttgtatgggagtttgcacaaatgtagagtgatatatttgggtgcaggatcatgctggaaaatgcaagaccttgagcctagtcagatacctcttctgtccaagtaatgtggggctacttatcccctctgattatttctttatgcataatatagggatgcatctatctaagaattgtcatgagagtgaaacaagataatgacacagtctttcaggaacttggcagggtataagtaaacaagataaacagatgagataaaacacataaagaatcagggaagttccgtgatgctttttttttttcccggaacttggaatgcgtttcgagaccactttttctcgattccttccccaggccttcgcatccttcaacttcttataaaggagctgctgaaagccagagtgggatgagcctcctgcacgacgtctagatcctcccagaagtgacttgtaggcagtggctgccaccatccaagaatgagagatgaggtctgcaggtccttttgaaacttctgctgattttagttaagcctatttcttccccatgctcctgcaacctcaaactcatcccaacacagggcatggatgaggagagttaggctctggctccaagtcctgggtcttctggtcttctttgaacttcaatttcttcacaggcaaaactgtgatgacaacataaccactcaaataatcgtgctgattaaatgaaccaaaacatgtaaatgagctcaggtgtacatgggataaaggaggcttcaaatgcagtgcctggcacaaagtaagccctcattaaatgggagttgcagtgattattattagaaatgtctggctgctggggctctgataaagggagaggccctagaatgatgaagtgacgtgttaagttccatagataacaacaaagtcaggccattcacactttgggactgtatttcttgacagtccatatatcattcacatttgcatcttactttatcttattgtcagatgactaccaagaagattttgccagtcttttctttctgtagctcgtattcttgtattatgaaaatagatatactgaacatgtctcataccaaataccttttctcttttaggattgttgctatttctgtggaagagtttgtcccatgagaaccactgtactggtatgtgtagggcatttttgttaaatattaagtcattccagagcccacataaatagtattaataaaggctcgctttgttttaattattgtagagatttaatgttatgtagttcatttgagttaaggcaagaattatttttggtcatctcctacgcaaaaaaaagcgttggtctagatgggtttataagtatattccagcagatatttgaggggaaaataggccaatatcttttacgatcatatatgcaaaaagccaaaattaatactagctagtggaaaacagcattaaaaataatttattacaatcaagtagggctcatatcaggagttaagggtaaatcaatgctggagaaatcttccaatgtgatctagcacatcaattgaatgaagcagaaaaaaagggacatgaacatctcaatatggagtacctgtatttagatagagctaaccaaattaacatccattttagtggaattacttctcacttaaatggatgaagtatacaaaaaaaaaaaaaaaatagaatctaatgcttcaacctgatgcctgggatgtcttttgcctgaggtctgagctctggagtgaacaaggaagacagcttctagatgatcatgagacaattcaggccaaagcatgtctctgtgatgctgagaaaggctctgaaagcttcagcaatgtggtgtccagagggcaatgtgattgaatgatatttcgggagaccacaatgcgaagttttatcctcttatagttattcataaaagtttatagcttcactggtatagatataactaaattggagaggaatgtgatttttcaaatatccaggggcaatgactctcagtacctgcagtagatgcacaccaaggggttgacggagaagacttttctagctcacttcacagttagtccccatcctggaggaaggaaagactgaatcctcacacactgcttgccaaagccatcttattcactcagggttaattcagaagagtcactttaggtggctactgtcctaactgatatattcatggaaaattagacacataacatctattagataacagaggagggttttctctcctctcataaatgaagctgcgcagcgatttggataaactgttcacaaaactaggcttggttttgtacacattaattgcataaagtatgatacttaataagcagaaacacacactggtttatttcaaagccattaaacccgcagtggattgactgtaggggatgaatattagaaagagcacagggctgggagtcaaaggggctgagtttgaatgacagctctgtcattcagtaggtaggtgtgctcggtgagtcactgctcccttttagacctcagggtctttatctggaaaacatggagattttaaggacagggttttgtcattcttctaaaacactgatgggaaatataggatgttgcctcttgagtttccatcaaagtcaattaagttatagtcacatgttgcttaaaaaccaggatgcattctgagaaatgtgttattaggtgattttgtcattgtgtgaacatcatagagtgtacttatataaacccagatggtatatggtatagcctattgctcctaggctacaaatctgcacagcatgttaccgtactgaataccataggcaattgtattgcacacagtggtaagtatttgtgtatctaaacgtagaaaaggctcaatcaaaatacgatattgtagtcttaggggaccactgtcacataggcagcctgtcattgaaggaaatcttgttaggtggtatgtgactgtatgtagaattgaaaccaaatatttaaaccaaagtttcagtaggcagcatgtttatgcctggggttgcaaatggatgactatgggaccaggctgcttgtctcaacagaggagaaggctaggcaaaggccatggccaaaaaatatgaatgtgcagcttagtcccagggtctcctggcagccactttgtgactcctggtttcttcatttgatcgtgcttaggtcaaatcaaaccaaatccaaacaaaacaaaatatctcaaaccttcactcattgattcttccaacaaacccgtatgtgtttcccatgtgccaggcactgtgctgggcatgaggagatgaaaagagggaagaccttagaggcagtaggaggcacatatgcaagtgtcctgtagcatcatggaagaccatgtgtaagaggaagaggctggagcccagaagggaaggggaatgaggtaggctgacccaggagaaaaaggtaaggacagaccacattcatgcttggagaccctggtaagaatattgtctatcctcagaacagtggaaagtcatccaaagtttgaagatggagaagggggttgtacgtgcaggggtagggaatgttgatgacagcaggtttgtttctgacactcgattgaaaactctagagggaagtgaccctttactgtagcgccttttctcaatgtggtgtctgattcttccagaaatcacattaccaactgcctgccaactttcccctattcctgcccttccagagcctgcccaggttcttggtgagccaggtattcctaatcctggaatcatatcactcaaatttaataacctctctcatgtgccagtacttgacaagttaaaagtaatttgaatatctgagtattaatattttaactatacaaggcaccacaaattatttagtgattttttaaaataaaaaagcaaataagaaaatgatgtatcaattcagattgcagggaataggagatcccaacacaggcttctgaaaaattgggaaaagcacccaagaagattataaaagatgactaatgagcacaaaacaacttttggcaagcacaggaaagtattagcttattccaagaaacaagacacatttcatccaattattggaaaataaatggcaagaaaaaccaaataccaagaaagtacccacatttatgtggaaaagtataaaagcaatgattcaggaactaatttgaacaatccagggatagtcatattgattccagcccattgctgcaatttgaaatgaagccaaatgccagaggacaatgagatctgttttatgggctcttacatgccacataggagggagggagccacaggaatgcaccacattgaaaaaggaattgtgacttctgatgggagggcttttgggccaagttaaatctcagaatccagctctccccctgctccccagacagtgttgctagaggtcaatggacagtggggtctgagcaagtcttcattgtgtgtgattgccccttgcttgcagggcctttagaacctttgcaccactcccactaactgcttgcagtacttccatcatgatgtcaatcccaaatacctcctacccagtttaaaacagcccttgtggtatatatgtgtgtgtactgcccagatggagggctgtggctaggaaagtcagtttccctatccgtaaattggaagaatgattgatagctccttgtgctacatatttctgctgagcaagcaaaaaaaaaaaaaatgaccttgggttagaacatccttcctgctgcactctgtgtggtcattgaatgtcacttctgtgcaggatgcagctgattcttttctctcctagtggattttgttttacagagggatctttggtcctgtgactgaaaggtgagttgggggtgacagtggggaaaggagacagaaggagggagagccaaattactctcactgtactgcagggaagtccagatggtgcccttgtcctaagcttccaaaatatgctctgggagggaaacagagacagcattttgctgacagcacttgggaacaggcgtgtgggcactctatattaagacttcaatatccattccaagtgtatctgtgtgtatgtgagagcactgtggctttacttggaaaccaccggtcccaatctctctggggcagattccatttttcattctttcctccctatccttgtaacccaggcccaaccattcagcaaagggtctacccccaaataccatggctccctctggggcctctgtcttttgccagggcaaaggttgtttccagtagaactgggtcagctagagggaaaggtctttatcccttgggtagccggagtctgaggcattcccaagggcgagtgggtacagtgtggttcccatccacagagtggtggcatgcatgccatgccagctactgtaccagggaggggcgatttcaagaagagactcagtcttggcctcaagcatttctcagtccagagagagagagagaaacccagctcttgcaggcagagctttataaattacaatgcatcttcctgcccacttcctttctgaacccaaacaatagcccttctgtgaattaggccaggatgctttgaaactgtctttcagacaggaggagctgaggacccaaagtcactcggttgtttatcaacagatctagacttaaattcaggtctctgattctcaaacacagtctaatttcgatctgtagacttggtcaagctgctgttttgtccggtgtactgtcctgatattgagaggtgacaatgtgctagcaacccttgctcgctctcgggacctcctcggcctctgcatccactctggccacacttgaggagcccttcagcccgctgctgcactgtgggagcccctctctgggctggctgaggccagagccagctccctctgcttgtggggaggggtggagagagaggcgcaggtgtgaaccagggctgtgcctgcactcgtgggccagcgcgagttctgggtgggcgtgggctcagcgcgcccacacttggagcggccggccggcatcacaggccctgggcagtgaggggcttagcacctgggccagcagctgtggagggggcgccaggtcccccagcactgctggcctgcctgcaccaagctcgaattctcgctgggcctcagccacttccctgtggggcagggctggggacctgcagcttgccatgcccaagaccctgcaacctcatccccgccgtgggctcccgcatggccttgtggtgcccggtcccatcaactgcccaagggctgaggagtgcaggcgcgggaccagatggcagctctgccgggcggcccagtgtgggatccactaggcaaagccagctgggctcctgagtcgggtggggacttggagaacttttatgtctagctggaggattgtatatgtaccaatcagcactctgtgtctagcttggggtttgtggatgcaccaatcagtgctcagtgtctagctaatctagtggggacttggagaacttttgtgtccagctaaaggattgtaaatgcaccaatcagcactctgtcaaaacggaccaatcagcaggatgtgggtggggtcagataagggaatagaagcaggccgccccagccagcagtggcaaccctctcgggtccccttccacactgtggaagctttgttctttcgctcttcgtactaaatcttgctgctgctcactctttgggtccatgccacttttatgagctgtaacactcaccgcgaaggtctgcagcttcactcctgaagccagcgagaccatgaacccaccaggagggatgaacaactccagatgcaccacctttaagaactgtaacactcactgcaaaggcctgcagcttcactcctgaagccagtaagaccacgaacccaccagaaggaagaaactctggacaccccatctttgaaaactgtaacactcaccgtgagggtctgtggcttcattcttgaagtcagcaagaccaagaacccgccaattttggacacaatatggtttggctgtgtccccacccaaatcttatcttgaattttagctcccataattcccacatgtgggaggaacctggtgggagataattgaatcacagggtggtttcccccatactgttctcatggtagtgaataagtctcatgagttctgatggttttatcaggggaaacccctttcacttggttctcatgccagctgccatgtaagatgttccctttgctcttctttcatcttccaccatgattgtgaggctcccctagccacgtggaactgcgagtcaattaaacctcttttctttataaattacccagtctcagcagcatgaaaatggacccttgcctgaccttcaatttaaaagaattatagtagctaccatttaaggagagtttcccatgtgccagcagggtcctcaatgccctacagaggtcatctcattcagttcttacaacaggtgtacaggcagggattactgtccccatttaccagatggggaaactgaagtgggggaggtgaaataacttgcttgaattcactcagtcagtaaaaggcagagccacatgttagacctggtttgtgggctttctcaccaaggattgtggggagcttccctgattgattgggtccgcattccttttttttttttccccctggaatctctgggacaccaactcatgcgtgaatctggggaattaatcttctcttgttgggccctggctgaggggttcagtgatccctgagctccattccagctctttctctggatttatctgtagcatccatacttccccaagtttccaggtgcttgtctcttatatccacaatgagtaacaccaccactagtgaattctagtgaacattattgggctataatgtgagccagggctgtgttagcctgttctgatgcattatctcatttgatccttgcaaaaatcgacgtatgagaaccttatcacctccaatttagagttaaggaaactgagccttagagatgctaagtaatgtatccaggtcacacagtttttaatagaacaagagcttgtgtctgatgccaaaaacaaaatgttaagcactaagttatctggcctctaatagacggaagtgctctgggacttgggattgtcaatcagacttagggggtggctaaataaatgaacccctgtggaatgaagtccccttgcactcctatagttagtgttttacttcatgtcagctgtggagaaataggcacagctggcttggtgtatctgtcagctgttaagtctcaggttctgtcttctaggtaggagctaccccaggcacagcactaaccctttcctgcaggttctgattgggggccggcctttggctcttcccggctgctaatgctatctccttcccaccttcaaggctccctgccctgagctgtccctcagggttctccatagtccaatcctgacttttccagccttctctcacctcctcctttacaacatacacctactgctgaaggggctttttgatgccccctgaacatgactcacagtttcacacatttgggtcattttttttgtttttgtttttgtttttgagatggaatctcgctctgttgcccaggctggagtgcagtggtgcgatcttggctcactgcaagctccacctcccgggttcacgccgttctcctgcctcagcctcctgagtagctgggactataggtgcccgccaccacgcctggctaattttttgtatttttagtaaagacgtgatttcaccgtgttagccaggatggtgtcgatctcctgacttcatgatccgcctgcctcggcctccaaaagtgctgggattacaggcatgagccaccacgcccggccacatttgggtctttatccatgcggtttgtctctaccaggaatggccattgttttggctgtaatttctgttagtggaacgcccctcctaaattgctatctcctccatgctggccttctggattttcctgtatgaatttgctgtcttcctccttttgaaatcttgtaacattaaagtaacattaaaatatgggcttgactgtgctttcaatgatagcttctctgcttgtagcagttcctccatagcctgtaagtagtaagaagagttacaaatctaaccctagccttgccacttcataactgtgacttagggcattgagttaacctgtctgaacttcatctttagggtagagataatactgtttatttccccagttgttgtaagaattacataagttagtgcatgtaaaacacctagtatccaccagacatgcaataggcactcaagaatcttaagttacccatattcccacatttcttattacctcttcccccaaatacacacagatcgtcacacacaaacaatactactgctgctaccaccaccacgatgatggctcaatgcccagtgtgtacaggatcacagcatgctagcgctataaagttccctagcagcccatggttttagtcactgttttgcaaacgagtaactagcacctgggttgggatcagctgccctaagtgagtacagtattgcagctaacatttactgggtacaacaccaaggcattgtacttggtgttttataagcattatcttatttgagcctcccaatgaatcccctgtggggttaggtaataacattttcatcacccctattttgcagagtggtggggggccgggggaccaaaacttagaggttaagtagtttacccaatatctcacttttctaataagttgaagagctagaatttggaccccaggagcccaatatcagatcctggctcttaaccagaagccagaatgaaagtgaactccagatagcctgcattattttaagagtcctctccagtgtctcagaaagggcttcagaaattcagaaaaagctcatttcttgattcccatgccagggctatctgcccaggggagctgaattgaacataaatgaattctaccagcccagatccctcaccctgccagtctcagtcttctcccggaaaagttaaaatgagttccctgagctctggctgctttctagtggggagggagttccagtggctttgcaggaggggagacttggaagaactccaccaacttagtttattccaaggcatgcccaagaaatggattttcttgactctgtcttggctgagacaaaacacacacctctcttgttggtctttctgagttgaacagtcttgtggccttaatgcctatcacattggatggtttcaggaaagggccattctttgctttcttggtccatgaattcagagctgggttgagcagtgatgagaaaatgaaccccctagccccagccagccctggatcctctcttgagttcattctcctttggcatttggtaagcaggaaccttgatgtcccagatggtagagccaagggatggccccaggcaattcatgcagatacctcagctggttgtagtgaatcattgtgtctatgcaagaaggacttatgagcactcagtgggaattctgtacttcaaatagcctattccaagtcaagctcattatcctgccaccctgaactctactccaaatctcctcctcttccttcatcccctctaacatggccatcatcctcccagtgctatatttatagacttgggcgcctactgagactcttttgtcttccttattcatgagagctcattagtcatgaagttctgtgaatttttgtaatacacttcatggttcttgcaactattgctgtcctctttatacccagtgctactgcttcagatcagggcctcaagtactctcaccttattattgcatcacttcctaactggtcttgctgcttccaaccttatgtctctcgaagccagtctctccatagccattgtgatggctctaggtctaaacatttcacttccctgcaaacgaaatccttcagtggcaccttagttccctatgggaaatgtccaggctcttttatccggcctgaaaggcccaccatgacctccagcttcaccattcacctccctgcccagcccacataagccggccatgccaagccactgcatggacctgactgtttgcacatctgtatctgtaaacacaccttcccctcctcctagaatgtccttcccccccaggttcatctggaaaactcttactcatccttcaaaaccctgctcaggcttcaccctccaggtagagatgctcatgcatgcctctctgctaccatcatgcccacaacatacctctattaaggcctctactgcttcatattgcaatgatttgtgtacagcgcatctcccaggtaaaatgagagctgcttgagggccagacagtggtttatagaaattatttccccaggacctagcacagcttctgacacaccataagcactaaatatactttgttgatatagatgatttttctgaattgatccaactgattcctttcacaagcacaaccactgcagggaagaaaaatagtcttcttacttaggaaaaaaattacttgacatgtcttaactgtaaaacccttgaacaagcactttatccttcttctgtggttactttttcttttttattgtgtcgctgtggtctggataaagttgtctgagttttattcatttcttaactctgattgctatcttgcaagggggatgggatgaaatagcaaacaatatattctagcttttttctttcccagaggcatatatagaacagcctctgaagaagtattaatattggaaaagatgctattatctgcattatactaattaatccatacatctacctgtcattctttcttttctatggcttttctcaccgcagtggtgtgctcttccgctgctggtaaattggcacaataaatctggggggaccacctctatttccagcagttcacttaacattttatcacgtggccgtggactcaggattgaagtcagttaaaaagattaataccatttaataccacccagaaggaagatgccagaagtctgtttaaggtcctgttattcatgtcttcatttcctttgtgcgtgtattgtgataagcatagccatcctttttaggctgctgctaataactacttaaaatgattaaggtaactagttatttcctgtaagaaaattgcgctgctgtcattaacacgaaattaacatggctcccatttcatcttcagcacacagcctgttgccccccgttgccttaaacaaacagaactgtctccagaaggctgtgcgctcctttgtaagaggcaaggaggtaagaaagcgtagttttgcagaggatgctgcccatggaggcagccggaggagggaaaagcatagtcccccaaactgccatgaggtttggaggagtaattagcataattgtcattattctgtatggcctgagcaatgtgaatgggatccgtgccctttaaaattcccagttctcagtcgggcatggtggctcatgcctataatcctagcactttgggaggccaaggcgggtggatcacctgaggtcaggagtttgagaccagcctggccaatatggcaaaaccccatctctactaaaaatacaaaaattagctgggcatggtgctgggtgcctgtagtcccagctactcaggggagaatggcttgaacccaggaggcagaggttgcagtgagctgagattgcgccaccgcactccagcctgggtgacagagtaagactccatctcaaaaaaaaaaaaaaaaaattagccaggtgtggtggcaggcacctgtaatcccagctactcaggagactgaggcaggagaattgcttgaaccctgggggcggaggttgcagtgagcctagattgcgccactgtactccagcctgggcgaaagagcaaggctgcgtctcaaaaaaaaaaacaaaaacaaaaaacacacaacaactcccaattctctcaatcagtagttctcttaggttggtgcaaaagtacttgtggtttttgccattagttttaagttttaagaacaaggaccgcaattacttttgtacccaacgaataagattttctcttacttgacacatgcaagacatttgcatgtgagagacactcccatcggaacactctgcttttgagaaggatctacacatatcttgtagggacatgaagcaccgtgatgcttgtaaggtcctaagtattaatggtaagtcagcaatggctgcttattgggagtcttggcacaaataagattggctagtgctacttaagtggagtctgtgaacatgtgtgtacaagttttagtttgagtacgtgttttcagttattttgggtatatacctatgaccggcattgctggactctgtacttttatgttcaactttttgaggaaccaccaaactgttttcctatattttaaagttgagcacttatgtgtgccaggccccgagttgaagagttcacgagatagtgtacttggagggtgaacatctagagccaggaggagaccagagggccaaagtagttcaagtcatctttgggaatctgtcacagttgtccctcttgctcacttgctcttactcctctaccccactctgattgtctgctgtgagtggcaccatcagcacagccatcacctgagagcatattagacatgcagaatctggggccccacccagacctactgcaccagcatttctgggggtgaggcccaggaatctgtttttaagaagccctctaggtgtttctgatgattactcaagactgagaagctccgagatagatgtaggtgcagtgttacccttgttgctcttacatcagaaaccctattggctgcaaagtgagcgtcagatactgcttttagagatagcttttagtcttctctaacttaaatacagtgaatcatatgcaacactccccacttttagcaggttatgtgcacccacttcacttacaactgcaaaaccctaccattccaggcagagtcacctcggttccatatcatgtcaggggctcttaacttgtcacagtagaaataacccagggttatcttagtaatcctgagactgtgctcttctttaccacccaggccagcctgcaaatgtgatgatgggtctaccacagagtccatggccacagagtagccctctgtggcttcctgacagccaagagcagcctcgatttgatatctggtgtttgttttaagcctttcctttttctgctgtcaggaagtggtaatgtagtagtgtgttgaaagagcatacattttgttgtcaaacagaccagggtttgaattctgattctgctacttgagcctgcaaaatgggttaataatatctactatgtggaataatatttgttcaataaatggtggtgatatggtttgggtctgtgtccccacccaaatctcatgttcaattgtaatactcagcgttggaggtgaggcctggtgggaggttactggatcatgtgggcggagttctcatgaatggtttagcaccatccactgtgggccgttcttgtgatagtgagtgagttatcatgagatgtggttgtttaaaagtgtgtagtacctcctcccttgtgctcttcctcctgctccagccatatgaagaggcacctgctcctgccatcattgtaagtttcctgaggcccccccagaagcagatgctgccatgcttcctgtacagcctgcagaaccatgaaccaatgaaacctcttttcttataatgtacccagtctcaggcatttctttatagcaatgcgagaatgaactaatagaagtggttactgctgttattaatcattgctgataattaaaaaaaaccaaatatgtacataaaaagagggagacagggtggagtagagagagagagagaactgtcataaattcctaaagactttttgaactactgtggccctctgtctcctcttggctctagatgtttgtcatccaagtgaactattttgtgaactcttcaactcagtgcttggtacggggtaagcactcaaaacaatttggtacctcaaaaagttaaacatacaattaccatataacccaacaatgccactcctaggtatacacccccccccccaccggctgccaattgaaaataggtacccaaactgaaaactgtacacccatgttcacagcagcactattcacaataccaaaaggtagaaacaacccaaatgtccatcaatgaatgaatgggcaatttgtggtatacccacaaaatggaatattatcctgccatgaaaaggaagaaatgacaatacatgctacaatgtggatgaaccttggaaacatgctatgtgaaagaaagcagaccaaaaactcacatattgtataataatatgtaaaatctagaacaggtaaatccatagagacaggttgccagaagctggggaagggagaaatgggagtgactttaatagataatggggtttccttttggaatggtgaaagtgttttggaactagataaatgtggttgcataacattttgactgtgctaagtgccattaaattgttcactttaaaatggttacttttatactgttaaaattaattaaaaatatatatgtatatatgtttatagaacaataaaggatgaaaggctgagcctgaataactgatttacttattcggaaaagcaaagccgtttaaaaaatattttacttctgttgcttctggctataactgaaaatccctcagtccatgtggggaacacagatgacgaatacgcagccctccagcatgtgtatgtggtcattaacttggccttgctggtccagggatttcaggtaaaaatcaggaactatgaaagttattaataactcagttgcttctaagacaggtgaacatctaagacagggccataggaatggtgtaatgcagtcaagagaaaaatgtgaaggagaaggatgcaggcaagttctcctgagagacagatccaggagcataaaattggcattttttctccattaaacaatttgggatgatctgaagtctcctccaagtttctgtctctctctttatcttaattagcaaagaaagtcttaggtacagtaagccctctccttccctaatggattagccagcaaataggaaactaagctttgggagagactaataatagaatgaagggaaagaaggacaaggattgactgtagacttaagctttctccgttcattcattccttcatgttccaaagcaattgcatttcttatttgtatgctacagtcattctccaccctcaaagagtttaccatttattggtgggggtgggggacatggacacaaacaagtatacagtaaaccacagcatcatatgtcagactgtactgtgcatatgaatcctttggcaatcttgttaaaatgcagattctgattcattatgtctggggcagattctgattcattatgtctggggcagggtctgagactgtttttctttctctttttttttttttgggatggagtctcgctctgtcacccaggctggagtgcagtggcgtgatctctgctcactgcaagctccgcctcccgggttcacaccattctcctgcctcagcctccctagtagctgggactacaagtgcccaccaccacgcccagctaattccttttttatttttagtagagatggggtttcaccgtgttagccaggatggtcttgatctcctgacctcgtgatctgcccgccttggcctcccaaagtgctgggattacaggcatgagccaccgtgcctggcctattttttttttttttttaagacagagtcttgctttgtcaccaggctggagtgcagtggcgcaatctcagctcactgcaacctccaacccctgggttgaagcgattctcctgcctcagcctcccaaatggagactccgtatttctaagagcacagaggtgaagcctgtgttcctggtctgaggggctagagtgtgataaccacaataaaaaggagatgccgtacagcagattcagcaaacagcctgcaggccatatcctatttttgtatggcccatgaactaaggatggttatacatttttaaatggttgggaaaaaactcaaaccaaaacaattgaagaaggctgtttcacgacaactgaaaattatataaaattcaactttcagcatctgtaaacaatgtttcattggaacagtcacccctatttgtttgcatattgtctgtgactgctttcccactacaaaggcagagttgagtagttgcaactgagaccatatggcccacgaagcctaacatgtttactatctggcccttcactggaaaaaaaaattgtctatccctggtataaagtaatatgggatttcaagagagagggaaagatcatttccagttgtattcatcagggaagacttcatggaggaagagtatatgagtagcttgaccagtgagtaggatctgagtggcagccgttggggaggaaggaaatctagtaaatgcataggcttggaaataaggaaagcaggtggcatgactacagatctcagtgtcgaaagccttaagccaggttgctgtccagactgccagcttccttctgaatgggaaagagaaatgctctgacacaaagaaactctggttcccagctctggaagattaaaccaattgggcaagtgtatggtggactacatgtgtatccgtgagcaataatgaaggccaggtataacagtggatttctgggtgagcatttggaagccagtggttctcaaagttggggagtgacactcccgcaccctgttccccagggagtgtttggaaacatctcttttgggttgtcatactaattaggggacatctcctgatacttactccccaggagtcaagaatgctaaaggatttacagtgggatgcagaagactatagttctgggcaaggtcacatgtcctcccctgaatgtcaacagcaccctcaataacatgctcagtctgaggactcttctgtggtgtagaatgaccataggttgagaaattaaaagacttggatgaagggaatggaacccacttggatagtgatgaatggagaccaagcaagagggcagattgatgctattgcttggcagtgagaccaaaagacttccatttcccccccaacattcccagagagccagaatgccagggtagagtacaaatccaaagagaatctatattgtagggaatatttatggtgcctatgaaagataagatttgcatgatgggtgaaggtcaatgacaattatttattcacaaccagtcttccagccttaatctgcacagtggttaggtggctagctttgcaatcagaaagagctgggtatgatttcagctttgtctcttcctagctgggaaacctggataagttattttaaattttcttgttttctgatctgcaaaatgggtatggtaatagattgttttaagtattgattgagataatccgtggggcaggcttagcacaatattggggccctcaggggtgccctgtaaatgagtttccatctctctttgcttcaatgaacacgaactgattttctgatgccatcagtgctgctgttggcatcagaatagcaggtgggaaaattagaggggaaccaattttagccatgcatagcattggttgatataagggatggcttctcaatcttggcactgttcatatattgggctggatagttctttgttgtgggggctaccttgtacattgtaggatgtctagtagtatccctggcctctacccactagagacgccagtagcacccccagtcatgacaaccctaactgtctctagacattgccaaatgtcccctgaaaggcaatatggtcctcgatcgagaccactggtttaaggtaagagaaaaataagtcgtggctgtttatctttttatacaaatgtaaggggtacaattgcagttttgtcacatggctatattgtgtagtagtaaaatatgggcttttagtgtaaccatcacccaaataacatacattgtagccatcaggtaatttctcatccctccccctgccacccttctgcgtctccagtgtctataagtccatactctaggtccatgggtacatattattaagcttcacttagacgtgggaacatggggtatttgattttctgatctgtggctgtttggggtgaagggagaaatgcaggattgctttgatttttgtcttagcaaaaaatctgaccataaatctccaagctctatggtctgtaaattcaacaacataccatgttttcccctaatgccaggcactgcattcgatcctggggacagatagaaataagacatggtccctgttctctaggtagggaccacctttttttgcagagccccagctgaggaagaagactcttgaaaactctggccatgaagtggccatttgttttccgggcagagtctgccatcgggtttctaaaaaacgtggttgggcagccacactgataagatgggaggccaggtggatttatgtgggtgtttattctgagagttgggccaaggcacaagctgaaaccgctggcaaaatgaaacttcccctggccactgtgaggaggctgaatttatctcaggggatgtggtttggttgacaagactgattatatggggtttattgtttacatgagtataatatactcagggctcaaggcagaaggtgggttttataaatcagcaggtaagtaaaataaatgcgttgggctagatactcctgctccctggataaaggtgaaaggggatggtgaattacagttaacacagaaaatgaagagaattcaaaaaacccagcggattccttcttaagcgaccatttactgccaccacccaaaggcttcatcccatttaccccacctacccatggccatatattctatgagaacattctgaaattttgtatatacattggaaacagaagcttgtctccttaccattaataaccaaatgtaaggaaatggaaagacggaacacgccctgataaacgtggggcaaagaagggaaacctgacgttgatgaagggctcctctgtagcaggcacagtggcgggtgcttgatacatacatcattccatttaattcacacaaaaatcctgtgggtggttatttcccaaatttgcctgcttataagaaccaccaggcatgcttattataaatccagaggtctttgtccctcccttggacctactgaatcctactgtctggggaaacatgaaaatctgtatttttaaccatcacttcaggggtttctaatgatcggctagattggaaaacacttcattaaactgtaattcatcatccccaagttatatggatgtggaaagtagctttgcctgacccttaattctaaacccttttcatggcttcatggtgcctccttagaaatgacaggtccaattaagacacagacaagatgggtttaaaatttgcctctgctttgcatatcagttccttagagctttgagagtcagtgtggtggagaggacatgaccgctgtaactggagtccaaggactgagttacagctctgtaatttattagctctgtgaccttagacaagttagtaaagctctcctggtcacagttttttcttctgtaaaatggtgattaaaaaaatctcacttgctccgactgcttccagatccattgtgtggaccaaatgagataatcgacgggaaaacgttttgcaaatggtaaagccgcctgtgaggtcttaatattatccattcctgatggagttgataccccaattatctgtgtaaccagtttcttttttgtgcaatacgtaaagctttgaacttttcttctcacttttgggtgacttcagacagcgtggatgatgtgaaaataaggaattcgcgtttattgacagatgaaataaaggatgaaaggtgctctctggcaaaggctgctactaaatgcaagaaaccccgggacaagccacccactgaaggcatgtgcacatgtgttctctgaaactcatgatatgtggcagccagtgctccactggattaacatggataaatgaatattaataggaccaccactctaggaaggataattgggggttgcctagatcactctctagtgactgagactgtcagagaaccttcagactcctaagcctggtcccaccctgcggcaggctgaataaataggtctttaaagatgttcatgttctaatccccagaacctgtgaaaatgttgccttacatggaaaaataactttgcagatgtgattaagttaagggtcttgagaagaagggggagattatcctggattatctaagtgagcacaacataatcacaaggatccttccaagtgaatagtggagcagggagagcacagaagatgtaatgtgggaccagagattggagtgtgatgagtgtgagaaggcgtcaactggccattgctggctttgaagatggattctgccctacagcctccagaaagaatgaagccctaccaacacgttgatcttagctcagtgaaacccactttgggcttctgacctccagaactataagataataaatgtgtgtggttttgagccactacgtttgtggtagtgttagagtagccataggaaaccagtgcacccccaccgttcccagtgtttatcagtggggtgctattgtcatgtgagtggaggctggtttctagcatagcagggcacctagcatctgattaagtactaagtgccagcctcccaaatcatttaactacccaaaacgtgccatgccctggttgaaaggcatagcttacatcgctgacacatctggggactaaaagaacatgtgggaatgggcttcagaggagcagaattttaaaaatacatttaaagcttaatggttctctttagtattaatttgctcactatgagattggaaacttctttatgcctacatgacctctgtacatccggatccaccacctggcccagagttggtgctctcaaagtgattgtgaagaaaataaatggattctttgattatatctcactcctccaaagagaatttataatgccttaaaatattaaaaagtgtaagctgaaaataatgaaatcaaatgccattaaaagaagcagagaaagagatacctagatgcctggggtgggtggtttgtttcttagctccacatttggccttgaattcctgactgcaaaaattagacaggcattacccacttgaacaccttcttaggtctcacatgtgggtcaaaggcaaattgtaggatgttaggagggacatatggtttaccagatatagccatctgaggactctcatgctaaaaatacaaatatatgtttgatctccagaaatatcccttacaattaggctagggatggttgaaaaatacacccagcttgattagagatagccagaggcatgctgctgtgaacggtttattattgagatttttggaggctatgaatgatggggaagatggcatgaagacccagatttgccgtctgtaaatcatttgagactctctctgtgtcatcatcaggactggaagggaagtcccataggctgggagtgggagatgggagggctagagtgtctttgtgtcctctggtaaagaaaacaaacccatctccagccccttgtgtctcctcctacctctgcaaagctgccaggtacaactgctctgtgttattgatgctaatgacccacgtaatggccctgcaagaaggatttcaaatctgcaaatgatggcttttgcaggcaccacaaatcactgagccttgcaatcaaatgcagagggacccagatcactgaaggacttgggataatgaatgataaaatgcagtttaatgtggacaaatgtaaaataatatgtcttggaacaaacaatcagaaggaggaacagctgctaaatgaattggtttgcattacactgaccagggaatagaaatgggcctgagtggcagccaaacaatcaacagaggtgaaggttgaagaggctggtccctgttgtaggaaaataaccccagaaaagtcagagggaggaaaatgatcaagttaattcctgcctcacaggcacctgatacgccacaaagaggaatacaaatggcctgacacccattctgagctcaatgctggctgttgctgcttaagctccttgccagctcctctgctcaacctccaaacctggggtgccccagggattggggggctaacacggtttggctgtgtccccacccaaatctcaccttgaattgtaataatccccatgggtcaagggcagggccaggtggagataattgaatcatgggtcggggggggcgtctgtttcccccatactgttcttgtggtagtgaataagtctcatgagatctgatggttttataaatgggagtaaccctgcacaagctctcttgcttgtcaccgtgtaagacgtgactttgctcctcattcacctgccatgattgtgaggccttcccagctatgtggacctgtgagtcaattaaacctctttcctttataaattacccagttacaggtacatctttattagcagcataagaacagactaatacaggtgccctaggacttgggccttggctttctcttcttcagcctcactatctcaccaaagtatctcaatcagtcctgtggcttttaagaatcatctataccctgaagatactcaaagttacaccttcaattgacctctccctagcttagatctcttagtcagtggtctcaaagttttctatgtattagaatcaccttgaggatattaaaaaaaatcttaatgtctacaccctagatgaatgaagtcaagatctctaggagtgggcccaggcattagttttaactctacaggtaattccaagatgcagttaagtttgagattaagttgcccacttaatctctccacttggatgtatacttagtgtctcaaatgtaatatgaccaaataaacttcattattatccctatttcacacttgatcatctcacacttgatcagtggatggcttccccatccactgatctctcaagccccaaaagtaagcttgatactagttgtttattttctctcactacctacagctactccaccagcaaagtcttcagttccaacttgaaaacatccaacgtcattctaccatcaagtccaacctgtaccactgcaagttttaattaatctgcttacttttggctcttctctactcacttctccctcttgtatccaaagtaatcttaaaaccaggtcatgtcacacccctatttaaaaacctccagtggcttctatcccatgtcgtataaaatccaagctcattgtcctgacttttgaaaccctcaatgactttctacatcttacctttatgatctcattttgtatcattcatcccttatccaccaggctcattcccatgtttgaaattttgcaccatttcatttgtgtaaaatatacttcctttgatcttcacagggctcactgggtcttgtcatttagatgacaccataaaaatgtctccttcttagatcattcttagtcattcaatatcaattagtcatttatcaccatgtagtattttcttgtttgttacctacaagccctcaccagaatgtaaattccacgaaacagggacctagtctattttgttcactgctaaattctcaatgcctaatatagagcctggcacatactaggtgctcaataaatatatgttgaatgaatgaatgaatgaatgaattctatcaatgaaagaaagcaaggcccagagaaactagcttaagattttatagcttatagtggccatgctctatggtttgtaccagtggtttccgggtcaagtttttgtcaatccatagtgaaatgagaacaaagacatcactgtggttctatcaaatagaaacaacttgcttatattttgagattatttacttattgcttttttgatattaaaatgtccttgctcttataaaatgctattgataatatatgacaagttatttgggagtttattttaacttcctcaacaaaataaaaactgtgataacccaataaagtttctagttttctaaaaaagttataattgtggtatccagccttcaagaatactccttaatgattcttgccacctgatattcatgctcctgtgtggttccctctcatgttgcgtagagttgaactgtgaaaccaacaggatattaagtaaatgacagtgtgcgacttccagggccacatcataaaacaccacagcttccttcttatgctcccttggatcacctgctttggggggagatggctgcaatgtcatgtgaacactcaagcagccctatgggaaatgtgtgtggtgaggaactgaggcctccagccatcagccagcactgattcaccacccatatgagtaagccaccttggaagtgaatcttctaccccagtcaagccttcagatgacttctgccttgggtgacatcagactacaacctctcggaagacccctagccagaactacccagctaagccactcccagattcctgaaacagtgaggtaatgttttttaagtcattacattttgggataatgaattatgcagcaatggataactaatacattgattaataacattccaaaaatctggagacctgcattgctgtaatcttttttgaattacggtttgcacgactggctagtttaaccactaaacatctctaagctttagctttcttgtctataacatagaaatagtattcatccctacttcttaggttgctgtgaggattaagtgagatgatgtctgtgtttggaactaatattattgaatgttatttttatcattattcttgttttatattattatggactatttcatgcctaaatgatttgcagtaccatcttctatgcctgaattgtatccctttccccatctgcctgcagaattacactttattccagacctagtacaagtatttatactctttgatgcccttcttgaccttagaagagctgatcctttcctctttgtccctgtattcttttctctattatagcacttatcatgtgtattacaattagttactgacatgtccatctcttctaccatatacaatcctaccaagcacttatttggctgttattacaggccaggtgttgtcctaacacttgtatatattgactcatgtaattgttacaataaccctaagaggcaagttctatttttatctctattttatataaggggtaacggaggcacagatttaagcacgcagtagagccaagattaaaacctgggcgtttcagctcccaatgtggtgctctcaaccatatcatccctcagagaaagggagcaccctatggacagagaccttggctcacttatgttggcctccctagtacccactagagtttttggaatatgggaagcttgtaataaaaataacagcaattattatctgctatataaaatactatgctgagaactttacaaagcagagattttaaaaatggccatttacaaatgagaatcctaaggcttagcgaggctaaataacttcatgtaaagctcctagaggtggcatagcagtcaggattccagcccagggccatttgattccaagggccattcttttttcatggcatcaaacacgcccaatgattttgaatgaatgaatgattacatgaatatgtgatggaatatcatttgtcataaattggcaaaggagaaagtgaatgatccgtgtgtacttatttctactttgagataaatataatttgaaataataatggggttattgagatataaggaaatgatgccacagaaggaagaacattgattttgtgctggacagctttctattttatgtggcctgctgattgccagtgacaatttccagtatagagactgacatcctttacaatttgagctgtccccagcctccatgtgccctgtggtgcaggcaacatgccttttctttctcttttttccctccctttcttccttcctttagcattttaaaatttatttatatttttaactgacaaatgaaaattcaatatgtttattgtgtgcaatgtgataatgttttgaaatatgtatacattgtggattgactaaatctggctaattaacatatgcattactttgtatacttgtttgtggtgagaacacttaaaatctactcttaccgatttttttttttttgagatggagtctcactctttcagccaggctggagtgcagtggcatgatcttggctcactgcaaccaccacctcccaggttcaagtgattctcctgcctcagtctcccaagtagctgggattacaggaacacaccaacacacccagctaatttttgtatttttagtagacatggggttttaccatgttggccaggctgatcttgaactcctgacctcaggtgatccgcctgccttggcctcccaaagtgctgggattacaggcgtgagccaccatgcctcggcccctctcttagcaatttttaataccacaatacattgctattaactatagtcatcatgtacagtagggctattgaaattattctaactacaattttgtatattttgactgacatctctctaatcccccaaccttcctccagcctctggtagccaacattcttctcttcacttctatgagtttaactttttaagattccatgtgtgatatggtttggctatgtccccacccaaatctcatcttgaattatcgctcccctattccccatgtgtcatgggagaggcctggtgggaggtaatcgaatcatggggatgggtattcccatgctgttcttgtgatagtgaataagtctcatgagatctgatggttttacaaagggcagttcccctgcacatgctctcttgcctgctgccatgtaagacatgcctttgcttctctttcaccttctaccatgattgtgaggccttcccagccatatggaactgtgagtctattaaacctctttttctttataaattacccagtcttgggtatttcttcatagcagtatgaaaatggactaatacaacatgtaagtgagatcttgtggtatttgtgcctggcttatttcacttagcatgtcttccagattcatctaggttgtctcaaatgacagaatttccttcctttttttttaaggctgagtagtattccattgtgtatatccactacattttctttaccattgctccactgatggacacttaggttaatttcatatcttagctattagaaataatgctgcaacaaatatgggatgcagatatcatttcaatatactgattccatatcctttgggcatatatacagtacagggattcctggatcatatggtggttttacttttttgaagaatcttcatactgtttccgtaatggctgtgctaatttgcattcccatcaacagtgtttcagggttcccttttcttcacatcctttgcacatattctccaacacttgttatgtttcatctttttgataatagatattctaagttgtgaggtaatatctcactgtgattttcatttgcatttgatgattagggatgttgaacattttttcatatacctattggtcatcggtatgtcattttgagaactgtctgttccaatcctttgcccatttttaaatcaggtgtttttactactattgagttgcttgagctcctatacattttggatatcaacttcttatcaggtgtatgctttacaaatattaatactttccttctgtaggttgtctctacactctgttgataatttccttggctgcataaaaggttttcagtttgatgtagtcccatttgcttttgttgcttgtgcttttgtgttcatatataaaaaaaatcattgcctaaactaatgtcatagaccaatgttgccttatgttttcttctagtagtttcatagtttcaggtcttacatttaagtctttaatccacttttagttggctattgtggtgcatggtgtgagttaagggtctaatttcattcttttacatgtgactatccagttttcccaacaccatttattgaagagactgtcctttccccagtgtgtgttcttgacacctttgtcacccttgctatcatattggcctgagtcactttcagatgttgctgagaaaaaaatcccaacccatgggatacttaaaacatggctcttaaaacttgatctaaaagtgctttagctaattgagatgtattgtgattccatatgaattttaggaattttttctatttctatgaacaatgtcattggtattttgatagggattgcttgaatcagtagaccattctgggtagttcagatgtttaacaatattaattcttccagctcatgagcatgggatatctcactacagttttttgttcctcttcaatttcttttcttagtgttttataggtttccttgtagatagcttttacttctttggttaatttattcttagggttttttttttttttttggtagctattgtaaatgggattgatttcttgattcctttttcagattgatcactgttaacatatagtaatgctacagtttgttttctatctacctacctatctacctatccatcctatctatctatctatctatctatctatctatctatctatctatctatctatctatctattttaccatttaccatgggaatgataggtttttttaaaacctaagattatctcatttgcagacaaggataatttgatttcttcctttccaacttggataatcattttctttctttctcttgcttaattgctcatgaccactccagtactatgttgcataaatgcagtgaaagtgaacatccttgtcttgttccagctctcatttctgtttatcaatgaatagtatttcattgtgtagatgcaccatggttaatccattaattattggcctattgaagggcatgttggtgtttctaagttttcacaattatgaataaagctcctataaatatttgtatgcaggttttcatgtggaaataagttttttattaatttaaatgaacaccaaggagtgttattatgaattgaccagtttcaactggccgtgactggctttgactggttttgagcagccatcactggttttggctgtccacgaccagcttcaacttgtttccactggttttgaatggtcttggctggtgttggccggtttcaacaggtcttagtcagttggtttcagccagtttcagccagtttcatttggttttgactggtttcaactagcttctgcgaatttccatgggttataacagatttttactagttatagccaatttggactagtttcagccaatttggactagtttcagcagggctcaactggttccagctggttttgactggttttagccagcttcagccaatgttgactggtttcattcagctttgaccagtttcagttggcttcagccatctgttttgactagtttcagctggcttcaactggtttaaagcagtggtagccagttttagctggttttggctggtttagaacagtttagactcctctgggtaattatatctttttctctttaaaaaaaaataattttaacatttttgacttggggttatatgtgcaggttacctgggtatattgcatgatgctgagtttggggtatgattgttcccatcaccaaggtactgagcatagcacccaatagtttttcagcttttcaccccctatccacccccgaccatctagcagtccccagtgtttgtgtttgtcatctttatgtccatgagtacccaatgtttacctcctatttataagtgagaacatgcagtatttggttttctgtttctacattaatttgcttaggataatggcctccagctgcatccatattcctgcaaaaatcatgatttcattctttttttatttctgtgtagcatttcatggtgtatatgtaccatattttctttatttgattcactgctaatggggggcccctaggttgatccacgtctttgttattgtaaatactaatgtgatgaatagaggagtgcatgtgtctttttggtagaacaatttattttcttttggatatataccccataatgggattgtgaggttgaatggtagttctgttctaagttctttaagaaattcacccccggctggacacagtggctcacacctgtaattccagcactttgggagactaaggtgagtggatcacctgaggttgagagttcgagaccagcctgaccaacatggagaaatcctgtctctactgaaaatacaaaattagctaggcgtggtggtgcatgcctgcaatcctggctacttgggaggctgaggcaggagaatcgcttgaacccgggaggcagaggttgcagtgagctgagatcatgccattgcactccagcctgggcaacaagagcgaaactccgtctcggaaaaaaaaaaaaaagaaatctccaaattgctttccaagtggcagaactaatttacattcccaccaataatgtataagtgtttcctttttctccacagcttgccagtatctgttgttttttgactttttaataatagccattctgacttgtgtgagatggtatctctttgtggttttgatttgcattcctctgatgattagtgatgtggaacattttgttgttgttgttcacttgtatattttcttttgagaagtggctgttcatgtcttttgcacactttttaatggggtttttttttttttttgcttcttcggttgttaaaatttcttgtaggttctggatatcagagctttgttggatgcatagtttgtgaatattttctctaattctgtgggtggtctgtttactctgttgatagcttcttttgctgtgtagaagatctttagtttaattcggtcccacttgtcaatttttgtttttgttgcaattgcttttgaggacttattcataaactatatcccaaggctaacatccagaatggtgtttcctaggttttcttctgggattcttgcagtttgaggtcttacatttacatcattaatatatcttgagtgagttgacttttgtataggtgaaaggtaggggtccagtttcattcttccgcatatggctagctggcttttccagcaccatttattgaataggaagtccttttctcattgcttatttattcccactttgttgcatatcagttagccatgggtgtatggcttatttctaagttctctattctgtcccattgttctatgtgtctgtttttgtaccagtaccatactgttttggttactgtggccttatagcatagtttgaagttgggtaatatgattcctccagctttgttctttttgcttaggattgctttggctactcatgttcttttttggttccatatgaattttagaatagttttttctatttttgtgaaaaatgatggtagcttgataagaatagcattgaatctacagattgctttgggcagtatggccattttaacaatattgattcttccaatccatgagcatggaatatttttccatttgtttcctgtatgatttctttcacagtttttgttttgttttgtttttgtttttgtaattctccttgtagagatctttctcctctttggttagatgtattactatatatgtgggtgtttgtgtgtggctattgtaagagggattgtgttcttgatttgactctcagcttgaatgttatcggtgtatagaaatgctatatttttgtacattgattttgtatcctgaaacctcactgaagtcatttatcagtgccaggagctttttgacagagtccttagggttttctaggtatcatatcatcagcaaagagagatagtttgactccttcttttcctatttggatgccttttatttctttttcttgccagattgctctggcaaggacttccagtactgtgttgaatagaagtagtgagaatgagcatccttcactttttccagttgtcaaagggaatgcttccagcttttgcctattcagtataatgttggctgtggttttgtcatagatggctcctattattttgaggtatgtttctttgatgtcttgtttcttgagggtttttatcacttagggatgttggattttattaaaatctttttctatatctattgagatgatcatatggtttttgtttttaattctgtttatgtggtgaatcacatctattgattcatatatattgaaccaaccttgcatcccaggaaggaagcctatttgatcatggtgaattaactttttaatgtgctgctggatttggtttgctagtatttcgttgcagatttttacatctatgttcatcagggatattgacctttagttttcttttttgttgttgtatctttgccagggtttggtgtcagggtgatgctggctttgtagaaagagttagggaggagtcccgcctccttgattttttggaatagtttcaatagagttggtaccagctatcctttgtttatatggtagaatttggctgtgaatccacctgatttggcctttttttggttataggttttaaattactgattcaattttggaacttaatattggtctgttcagggtttccgtttaatcttgggaggttgcgtgttttcagaaatttatgtatttctgtgggattgttgtaatgttaccttcgcagtttctgattgtgcttacttggatcttctctcttttcctttggtaatctagctagtggtctattgatttttatcttttcaaaaagccaccttctagattttttgattctttgtatggatttttgggttgccaatttcattcagttctgctcaattttagttatttcttctcttttgctagctttgaggttagttcgttcttgtttttctagttcctctaggtgtgatgttagattgttaatctgagatctttctatgtttttgaggctggtgtttagcactataaactgtccccttaacataacttttgctgtatcccacagattttggcatgttctgtctctgtgtttatttatttcaatgaattgttggacctcttggatagaaccacaaaagcataggcagcaaaaaacaaacatatagttgcatcaaactaaaacgagtttgatgcaactgtattcttctgcacagcaaagaaaacaatagagtgaagagacatcccatagattgatatgtatatacatctgtgtctatgtgttttggctttgggaaatcagtaaaccacaggactttgattttaatttatgtacacaggtaggtatctcccaggggcctcttaagaggtaataatgcaacgtaatgaaaaaaaaaaaaagcaccgtgttagagctgaactgtactagtaccatcacctatgtactatctccatgtgggcaaattacttaaactctctgtacctttgccttcctatcagtaaaatgggaacagtaacatgtattttagcttcatggtgaggattaaacataaagctctacctgacttgggcttcccattcatctctgagcttatagcctaagatactccccctacagcacatttctttccagctaccttagtttcttagtcattcctcaaattcactgggcaagtgcctgcctcagggcctttgtaccagctcttccctttgctcaaacattttcttctcagatccccaaatggctcaccacatcaagtcttggctctcatgtcccctcctccatgaggcttgtcctgactcttctgattagttctgtatcctcctcctgccactctcaagaccctttgctttgctttctcttctttccatagcagttaacatctccttgtagatgagacgttgtatttattaattagtatctatctccaactgctagaatgtaagccatatgagggccagggtcttcgtgttttacactggtttatccccagcaactagaacacagcctggcacatagaaggcaccccataaatattcactgaatgaataaacaaatgaatgcatgaatgaaatcactcagtacagtgcctggcatattgtacacatctaaggaatgtagctattattgttgttacctggatttccccaggatacttcatcctggaactgtgaataattttaatgcccaatttcactacttgccaaacctgcacatctgcaggtgtcaccctcctttttgactactaccctgatgtctcctccagtcatttataattggggcccaggtggccatctgattttgttctttagctctggacttgtggtggcatcatgtacttgaagtcctatgggggtggcccctctctgtccagcagctgctgccctctgtgggatgctgctttcctgcctccctgctgggtcctgctgcttcctcatcaccttgccagacacagcagatgctgctgctgctactgttgctgcttcccatcctttctgattgctgtcgctatgttctccctagaaactcagaaaatgctctgctccctcaccttccgtctggctggctcatctggaccctgaagtgaagcagcgtgtgctccaagcctttcaaggtcactggacgaaacaagtcttcttcagttttcacttaggaccagtatctgacaaagagatgccatcgtgcccttaatgttcttgtctcccttctgtttttcttcctgctttactgaggtataattgatagaaggcaattgtatatatttaaggtatacagaatgactttttaatatttgtagacattgtgaaataatcagtcaaattaattaacatatccatcacctcacatagttaccttttctcttttttctttgataggaacacttaagatctaccctcatacaaatttcaaatacacaatacggtattgttaactgttgtcacttatagtgcattaaatctccagaatttattaattttgtatactgatactgtaccctttgcccagatctcctcatttgcctctccttccaacccctggtaaccaccacctactctctgcttctgtgagcttgactattttagattccatatataagacatcacatagtatttgcttttctgtgcctggcttatatcacttagcctaatgtcttccaggttcatccatgttgcaaatggcaggatttcctttgtttttaaggctggatgatattccattttcattacccattcatctgttcatgaacattatgttgtttctatatattggttattatgaataaggctgcagtgaacacgagagtgccaatatctgttcaggataaaaattttatttcctgggccgagtgtggtgactcacgcctgtaatcccagcactttgggaggccaaggtgggtggatcacctgaggtcaggtgtttgagaccagcctgggcaacatggtgaaaccccgtctctactaaaaatacaaaaaaattacccaggtatggtggcgggcacttgtaatcccagctacttgggaggctgaggcaggagaatcgcttgaacccaggaggtggaccttgcagtgagccgagatcatgccattgcatgccagcctgggtgacaagagcgaaactccatctcaaaaaaaaaaaaaaaattatttcctttgggtatatacccagaagtggggttgctggatagtaaggtggtttgaggagtctccatagtgctttctagctttctttgaactaacctcctccccttcttgcaaccggagacacacacagcccccaggcctactaattcctgcaaatgcttgtctgccagcaggtggctactggtccctcatgttcagtttttgcttagcttcagcgaagacatccctcgagagcataagaaaaaacagtcatcatttttaaaaatacagaaaaaatctattgctttattgcatgttggtagactgctgttccctttgacagtccagttctgcatgacaagtctacttgcatgtcccgacagatggcccatggtaacggggcattgctgatcttgttacaatgaaatctattcaatgaaaaattctccccagcagatgtgtataccagcttcatccccatgtgggtatcaatctctttatgagacattgttttggtggtatttataagcagacagttgtaggataaagagagagaggtgactgctattagtattaattatgatctcttgcatttagtgcttcatgctttttcaaaaatgtttccacagctgttcctttatttgattcttgcaacatccccatggggtagacatcagagatgaagggagaaggcatgcaaagtactttccttccttcctttcaagatgttagaataagtttgcaccatggttgtggccatcaggtggtaggctgcacgatgctgcagagagaactagactgggaatcccagctctgcctttgaaataggagagcatccttggagaactggtgaatgtcccggtcagtgaagtagtcttagccgggttgctgcagtggccgcctaacaggtctcactgctgtctttgtcttgcttccatctgtcctcagtgcagcagccagaggggatgttttaagtcatacttcagataatatcgctgcactgctcacagaccctcccaaagctctccaccccactcagagcaagagcagaatcctggcaatggctgacaagacccctgggttttgtccgacatcttctctggccccttctcccacctccgtttgctcatgctctggccacattggcctccttggtgctccttgaacatggcacagttccatgggcctccacggcacctgcttcctctgctgccacattgttccccacctgtgcttggctcaccccctcatggccttccatctgctcgtctcaccttcacgtctccgtgaagcctgtcccaatgactgtatgcttcccttgcctgcctaacctctccttcctaatccttctcacctgttctctggattgcttttcacgacagcacttaccgtcgcctaacattccgtaagtggtcacgttcctgggctgtcggaacaccacaaactgagggacatagatggagctggaagccattatccttagcaaactaacacaggaacagaaaaccaaacactgtatgttctcactcataagtgggagctgaacaatgagaacacatggacacagggagggaaaccacacaccccggggcctatgggggtaggagtggagggagcagggagggagagcatcaggattaatagctaatacatgtggggcttaatacctaggtgatggatggataggtgcagcaaatcaccatggcacacgtatacctatgaaacaaccctgtatgccctgcacatgtatcccagaacttaaaatttaaaaaaacaatttttttttcaaaagtctgatatcaaggtgctggcagggttggttccttctggaggctgggaaggggatctgtgctatgctctctcccaggttcttgtggttgctggcaatccttggtgttcctcggcgggcggcaccatcactccggcctctgcctctgttttcacatggttgtcttctgtctgtgtcccaatttccctcttctcataaggacaccagttgttggatcagggcccaccttaattcagtatgacttagtcttaacttgattaagtacatctgcaaagaccctggctccaaataaggtcacgttcagaggttctgggggttaggactgcaacatagctttttggagactcagttcaacccataacactctcatttatttatttattttttttatgtttcttgtttgtttacctctgctcaataaattctgcgaagattggggcctttaatatatgagctggtaggatcccatgatactcacaaatgtcagcttccttccctcaagttcttaatccttttaaatattatttatatccccaaatgaaagtctcataatagttaactctcaattattcacccatgtttggtaacaggccaagaaaacaatttcacagtcatttgtaatgtattgccagaaaaatcctattttgacaaattagacattctatcaaactttctagcttgcattcacattccatttacctagaggctgccacagttctacaaaaggttttacgactagagacagagttctgagacacattgtctccactcagaacctctttctgtggaccttgtagtcaccatgtgtacctccggccaccccatcctgccctgggtcttgtcctcaggttggcaccttacccagatgtcacaaatgcttctcagaacctgccaaccagactacagaatcagacccctaccatgtgagagtcagaagggatcctaaaaatcattcatttgttcactttacaatatatttcttgagtcagaagggatcctaaaaatcattcatttgttcactttacaatatatttcttgagcacctattatgtgccaggcattgtgagtttcctattctattccctttgaacctcacagcactgtgcaagatagatattatggtctctgcattccagatgagagcacagaggcccagagcagttgggagacttgctgtgactactcagctagctggcggtagacccagattcagatccagcattgcctggatctggagccctttatatgaccttgccttgaactactgggcctctgcttttcaatcactctcatccttggtggcacacaagatagccaatagaaggctggtgacaggtcattcttattctcaggcttgtagaaaattttgtatactagttgacattttctcttttacagagaatctttacctttataaatcactttcatgaaggcagaggaggtgctgtgtgatggtggcttccacctggaccccagactccctctccgcctttctctgcctggggagacccactgtgtgcatggcactcactgactcccatacctctggctatcaaaggtttctgccatggccaccctggaaggaaaccagagggaggtagacagggagatcaggtcccttctactctggttcctgctctgtgaaattgtctcaggctggctgtgtccagagggtccctggttctctcagggatgccaaatctacaagaatctctcctcttccagttcctataacctctccttccttttgtctctttagaccttggagtagtagcagccaggttctttctatctctgggttagtgcattatctctggtggctcccttacccaggactttgggaatggtctttttgtaatacattctcctcaaataattcaattttgagtgttctgtatgtatcctgctgggaggttgttatatacaaatcactgtgcccgtttagcagagaaggagactgaagctcagggaggttaagtgtctttctctaggtcgtattgtggagaaagtggctgactggggacttgaatgaggtccctagtttcatgctcggagggcaaagaggaatgtccaattggcctgagataagcctctggtaaaatgtactgtacataataggtaatcaataaatgttggctgatgacaaacatgttttctttgttcattagttatagtgattatgttctaaataactccaacaaggaagtcagcacatttggaatatcattatctttccatgataatatctttccatggaaagataatgatattccaaactgggagtgtccctagcagatctgagtctgtgtattggccctggggtgggccagccccttagactctatggtctcattctctttgtttacaaaattgagataaggccttattctctccccaccccacccatccatattgttttgagaataaaatgagaggatgtgtgtcaagggtgtattttggcaatagtctctgagccattttctgagcacctccatactgttgacactcaagtaatatttcatcagcattccattcagggtcctcccttaatgaggtgtgcgatgtacaagagtcgtgaggtggcaaaggatgggctcctgaggaaacacttaggaaactgggctttctgccattaaaagagacaaacctttgtggtgacctaattaaagtttttaaaattcaatttggaaagttagcaagctaggctcctttccaggaaaaataaggagtcagtgcatgacctaaccggtcccgggctgcttgccattccaaacaactgcagtaagtttatcaccttctttcagggactgaggtttccaggcacagacttggataagaaggatgtcctatggggtcacattgatgctgtggcccaagagaggttgccatgactcgagaaaggttatgaagtatggttttcactaaaggaaaactgatctctttcgattgtttctatggaagcttgtggattataaaacagtatcctttcaaatccatccatccatgtactaacccatctatccgtccatccattcatccatccatcaatgcatgcatgcatctatcattcattcattcatccatccatctatccacctattcttccggccatttatttatccatccaacatatactgagttgctactcccaccaaacactggagattctatactaaatatgacataaccaatactttgaaagagcccaggcttcatgtaaaagcacacaattgaaacaatggttacaagcacaaggcgttaagtcaaaagaccttggtttgagagttgactttgtaatttaagtggccctgtggtcttgggcaagtgtttctctctaggccacatttttcatccgtaaaataatgtagctgaactcaaggaatgctctctaagatctcttcatggtcagatatgctaagattctctgtccaggcaaattcagggcaagatgagatcatcatgtgagtgcagacagtgcaataatctagtcagtggtctcctctgtccaccttgcccatccactctatcttctacagtgtaggcagagtcatcttttcaaaagaaaatctatcacagctgggtgtgatggctcacgcctgtaatcccagcactttgggaggcgacagtggtggatcacctaaggtcaggagttcaagaccagcctggccaacatggcaaaaccccatctctgctaaaaatacaaaaattagccgggtgtgatggcatgcacctgtaatcccagctatcagggaggctgaggcaggagaatcgcttgaagctgggaggtggaggtggaggttgcagtgagccaggatcacgccattccactccagcctgggtgacagagcgactctgtctaaaaaaaaaaaaaagaaaaagaaaaaagaaaagaaaatctatcacatcttttttttcattcatccctgcagtggtggattctattcctcttcggctaaagatcaacattcttaaggaaggtcttcgcagctcttcccagttctccagctcattttgtattaagccttgacttgctatctttgctccttaaacttgctatgttccctcttattacaaggcttccgtgtggcccacttgtacctttccccatcttctatcctgggagaactgctcatccttcagatagcagcctactcaccatttcttcagggacactttctctcacctcccaggtgaggcctggcttctatatatacacatagatcaatgtttcttccttttagagcacaaaccccaaccctgaaccatagcagaggggatccttagtttaacatctggctgccccaccagcttaccaccctcttgggagaaggaactgggtctagtttgctcactactgcactccctaaaacagtgcttggcacatacagggcccccagcaagcattcgtctgaacaaacatggagaatatggtgagtgccctaggctgacaaatataaattcctcatacccggagatgaggacaggaaatagcatccttattggggtaattcacttgaaaaaaaaaatgcctcaaaagaaatccacccatatgttgtaaactcactgctcataagagcaaggtgctctctaaaccccatcaggtagcccacagtgtctctcaaaccttaagggggaggacccttttgaaccaaaatggatgcaacaatagctgtgaagccactgctgagctgctgacggagggtagaggtgacaggtagagatggaaaaaacaaaaggccagagagacagaatttgaccaggggtctctgccactgtgcaaggtaggggtagtttttttcagtctagaatattggttaagtagttgaaaaagccctagaggaaaaagaacaatccataattgttcctgagtgtggttaaaaagcattttgagtaggaatctgtgtagcgcagtggttgagggaatgtcagacaggtctggttgaagtcatagttccagcaccgagtagctgcgcagtgctgggcaaatcactttgctctgagcctcaatttccttatttatggggataatggtatgtttaccattgggctgttggaagaagaaacggaggatgtaagctcatgcttaacacaaggcctggcctacactcagtgctcttaagtgaaagctgttgtcagtgagatgaattactttgtcataattctctgctcacctaactgtccatctggtctgcatttgattcctgagtaaagccatttgccagaaatgagctctcatggaaactgtacatttctgtggctctaaaccttgactcctctctttttctccatagcataccaagtctagcagtaatttgtgttggctctcctttcaaaatgcatgcagaatccagttgcttctctctccttttgctgccactgccctggttcaagctatcagcatctctttcccagaggactgtagtggcctcctaataggcctgcctgccggggcctttgccccctatggtcttctcttggctaacagccagaaaaaacctgctaaaagctaaatcagatcataccactcccctgcttgaagatgtctgatggccccatcacacttagaagaaaatccatatccagatccagtcccccaaaaccttcaggattccacattagccaacttttttgatcctatgcactctctcctaacacataggttccagctacagtggtcttgccacacaccaggcacactcctgcctgagggccggaaacctctctacctagaaacttgcaagctggcctttccatctcctttaggtctttgttcatatgtcacattctagctgaggccttccctgactgccttatttaacactgcaatccccaccccacactggacgccttttcctataactcatcccctactttattttacccacagcgcttgtcactatttgatccttatatattttacatatttgtctattatctgtctctcccactaagttccattacaaaagagtttttgttctttttttgttccctgttgttcctcggtgcctagattctcatagaagcaatgtgctaggtgcttaataaatatttatcatgtgaatgaatggtcagcccacttcttggggtgaagccttatgtgtatgctcagaaactgtcctggcttataaggttagtgtgggccaggctccccgagcattctttttatagagattctgctaaaatcaaatttctgaatcctctggactgcagagtcagtctggcaccttagatgtccctgatacccagcctaagctttaggcactgtgacacatacttttaaaggtggagaatgagtcagaatctgataaggtataaatatttggttactcacctcctgaaggtgaattagctctcacaggttgccagaaatatctctcggttccctgaagctgaaacacacttgctgatgtgcattaatagccaaaatggtaggaaatggcagagtctgccattattcatccacttaccaggggaggaaagaagataaatttattgtatatgaatgaattaacacaggcattgtgcctgttgagcaggtgtgcagggaaggaaagtggatgaatatgtgtgtgtgtgtgtgtgtgtgtgtgtgtgtgtttctcatgttcctatccttaatcaagaaaatggaatcccttctggaagacctcatgaccacatttgaagctctaccatttttctgttttggagaatagtggtttgggttttatagaaaaactggaggcagctctgagtaagagaaacatggtggtggtgatttcccagaactcatcgggcttctccaagttgggacacatgttggtcaaaggatgagctgctggcaattcatgatgaagacactggagtggataagacactcatggagacacttaaagcaggacaccaacctaggaaggatctggaagtagaagtgagtggaagatggcactaaaagtggaagaaaatcatgaaagacgtgatctgtccttgctgcttcagtgattacaagtgggctccagcagtccttccaatcagattctattattgaagaccagtgtattatttaaatgcttctctcaggagcttcgaaaggaggcagagcgaatagagagggaaagaaaagagctctcatgcctccactgtggcttggcactgggtgggtagggcacaggtgctggatggcaaagcattggcttgctgctctgatggccatgctgatgggacacagggaaggagaggcactgaacacttagactttcacagaattttcaatatcaatatgcaacttgtgataggttgtagttaaataaatttgttgttgtttattaaaactttttgcatcctcatgttgaggaactcaaagtagaaaataatgtctgtagagaaagtatacttttccccaggtgtgctgagtggcagctcttatccagtgacgtatactatcaaaaataccaacttggactctgtgatggttaatgttgagtgtcaacttgattgcatggaaggatgcaaagtatttttcctgggcatggctgtgagggtgttgccaaaggagattaacatttgagccagtgggagaaggagacccaccctcaatatgagtgggctccatctaatcagctgccagtgcaggtagaataaagcaggcagaagaacgtggaaggactagacttgctgagtcttccgatcctcatccttctcctgggctagatgcttcctgcccttgaacggcagactccaagttcttcagcttttggactcttggacctataccagtggtttgccaggggcccttgggccttcagccacagactgaaagctgcactctgtcatcttcccaacttctgagatttggggactgggactggcttccctgctcctcaggttgcagacggtctattgtgggacttcaccttgtgattgtgtgagtcagtactccttaataaactctccttcatatatacacctatcctattagttctgtcccttcagagaaccctgactaatacagattctgagggcagaaactcattcattcatctattcattcatatatccatctattcatttacttgctcatctagcaaatatattttgagcacttactatgtatcgggcagatgtcctgatacagaagtcaacaagatgaacaaatccctctcttgaagcttgaattacagtggggaagacaataaataaaaaatagaaaagataacttcagagagtgaagagtactgtagagataataaaatcagtgagtgatgtagagagctctgggggcttagagttcaggctacttcagataagatgattagggaatgcttctctgggaagggatcttggtgctgagacctgaacaatgggaggacccagccacatgaagatttaaagtgatgactcacaacctttgaagtgcattcatatcacctgggagtttttaaaaatagatggtggaccccacctccagaggtggaaatttaattgacctcaaggtaaggcttaaaattattctaatgtgcagccagggttgcaaagcaacctagactagaagtggaacttactagacagaatagcatatgcaaatgtcctcaggtagggaatggcttggagtgttccccaggcagaaagaaggtaggtatgactgaattagatggaggtaagaaacaaatttggggagggagtcagggattatattcgcttaggtgagctggtgagcatgtcacagatctagagctgggccccacagtacacagaagtacacagaaaacaagagctccttgctgcgtgcagtggcattgtcttgtgaggagccagggagttggaatgggtggtagggagaaaccccatacatttcacttcttcagtgtcatcacacagcaaactaatctgaactgcagaatttctctggtgatcagctgcctgttttcctggggtgatccatctatgaaaagtttccaaattgtgttaaaactgccagtttctcgacaaacagcacggagtgtactttccagggagaaaagttcaataattaaaatgagtcagcactgaagaactggagggcggtttgatctagtttagcagccgacgttttcttagcagaaaaatgcaatatccataatacataattttgtgctgaacagaagtcaactagaacagaattgtctcaggagggaccaaagtcagcttgccagaaaatctttttgaaggcagcagaaaacctggtcttcaaaagctgaagttggggagtggctgaggggccatgtctcaggtgcctacaggctggaggagctccctgagctgttttgacagggactcccctcttgctctctccagagcaattttaaagggcagataaacacaacacccaggttgtctgaacacctggagttcagaagcctgacttctcaccaccagcagaaagacctacttaatattgggcagctcttattctagggactaagtttgcctttgcctggggtgttaccacaggaggtgggagtttgggggtaattttttgtttttctgagaaaagaagagtgattaaaggagaaaatcatttcctctgggtggtaagggtccctgcaaaacatcccccgactgagcttccaggaagagtgaaaactgccaaacctgaaagtggtttggcttggagtctaagtccccaccagaggttgcaagtcctccctgtgcctgcagcacagtctcttcctggggctggctccgcgatttcaaaaacatagacaaattggctctcttctggcctcctgaagttcatgcaatcatgggaccaactaaatttgtgttagattatgccaaagactgaacaacattttgctttttttttttttttttttttttgcttcactgacaatagtccaagagaggaagccttcaattagagtagcagaaaatgctgattagaatcaatcaacacctctagaagtttaaacacttaagttaattaaatggttcagtaaacttgaagcgaaacttgcaaacagaaaacgcgacgtataaaaggatgcttagatttttaaaaaacagataattatccaacaagctcaacatcaacctcaccaaaggctctgtgaaaatgattaggcaggcagcgcattaattttcaatgcaactcacacttaggttcatatcactactcaaaagcaaaaactcatgactcctatcagcgggtgtgttgttctggtttcgagatatactattaggaaactggcaatgcacctgttgtattttagtagtcctgaatattttaagagatcactgtttccttaccctcagtacaaacaaaatcctgcaaagacagatctttcctgcaaagcaaaatcttgctggttttgtttaattttaggagaaggcccaatctgaatgagtgaaaacatgaaacacagattttttttcagacactaaaaatttgtaactcttctgctgcaaaataaagtcaaactagatgtcttctgttgggttcctttagacacagcctgcgatggagagtctagttcaagtgttttcctgaggatatggtccccagaaaaggggaaggaggaaagcgggacagagctgaaacaaatatctaagcaaagcttttgatttgcctgcagattgtttcagtctgagcccataggagggcgctggagtatgaatctcacaacaaaattagttccacctgagacaagaagatcagcctctgatgccccttggcatgtatctattagtcatgggccgtgggcttctgctgggggtgaggtgggaatgtggtagcctgttgagcagttagcagagggcagtcccccaggaaaagcggtggctgtgaggtgtaatcagacaaagtcacagctgctgggggagaggggcagcggctaccgatgggatctgggcaggaggtctacatgactggaccaaggaacttctgcctcatagagattgttgagtgatcttaggcaagacaaaagttgtctttgataaacaagcctattctaaagtgagagctaccccaggctccagacactatcttgttcacctctgaacataatgggtcatcaacaaatgtgtgttaagtgaatagcaaacagatcacttgcagtgtccactgaatatgatgcagcttccatgccctttctacgcatttcacaaacacccactgaagatgaagcaataacttgctacttgaggttcagtcccatcagaagacatgggttgagcccttgtgtagtttttcattagtaatgatgccttgtacctcagttgtccaatctttaaaatagggaaaaatcacaacatgacagggcttttgtgaggattaggagaaatagcacatgaatatacttagtaatttagctttttctcataaaatgtttttctttggaaaaatttcagaaaagctgaagtgcaggaatagagacatttaaagctaaaggattagaagcctctgataataaaaatttgctctgtaaagataaagcaatactagaactgtgctgtaaagtcaataggcaccggggattgatattgatctacagaatacacttgtaggaatgaagctactccataaagccaggcacattgagaatgagcatctcattgttttatctcccaatatagtgtgcaggtcaggctctgaactcttcttaactagaaagatagtgagttgcaaataaaacaggtgttggccattaatgaggtctctacgcacaacacttactatactacctctcagactatgtggagtggtttcttcttttgggggtttgccaaaaacaaagtaacattgcctacgaccttccttccataaaggcaggaggagggtgagtgtctttgtctgcacaggacacacagctgcaagaactctgtgacttggtgttcccactgtctgattatctgttgtgtcctccacagatcctcttttcttgcccctgctgggaagctatctctggttctagagcagaaggccatcacagaaactcagccaaacagtaaattggaggtgaggttttcaccaggaccatgaagacttcacttcttcaatcgggtaacttcccaaagaagtattttcctactttagagatgtggaaggattgggagctgctactcaagatgatcttacacatgcactgaatggtttgagcatcattcttatcattgattaaggggctggatcaacggctggacttcaggcatggtcagaaggaaaaaggagcctataattggccatttcttggctgggtcatgaccacagcaagggcatagatgtttaataggcagtgtaaggttacaattccaaatatgcattaactgaacccatcaatgatatctagcggggacaacgggaggacttgaggacaattgatgatggtaagtcatttgacaaaaatagggcctgaaaaaatacaaattttggttctatatcttttgaaaaatatcactccttagttgtcacttaagcctaggaccaaaggctagctagcttccctaatcactaggcttacttactagagcaaagggtagagtgtgggtacaggcatctgttgttatcttgcccagcatatatttatttatccctcttcccttggtaacagcacccttcctttcctttgaataactgtgcctactgcatttccatatggccctggggggcaccaatcctggtaccctgttcctgggtaggttcatgaccttacaggttggccagactcagtctcccaggaatctgaattataggtggagtgaaatatgaatggaaggtgaatgaagacaagtcaatttgatggcagttctcagaaagaatgaatcggagatccctggtactgacctgatgttcctgaccttcttgtggtccttgattctatgagttacttagtgttctctcaaataaactaatccttaaattaactagagtggcttttccgtttcttatagtcaaagaacactgagtgctccctgccatggtgcccctaaggagagaaaggccagtctctctttcttttgctctgtctgtatatgtgtgcatttgtgctggtataagcactgacaccagttcctgaggcctccataaaaggtacttcaggccccttttcaatttgagaggcagggtgtgatattattatatgttaccatccatctctttcttaaagaggcaaagtctcataggggaacaagcatagattttgcaatccagaaaaaattgagtttgactgaaaaaactgagttccgtcatttgcaatttatgtaatcttgggcaaattctgtatcctttcacctttgtcacctgtaaaatgggtacaataatacctgtcttctcacaggggtttgtgagatttaaggcagtgtataaaaagggccaagtattgtgacttgccctagaaaaataatttccttcctccctctggagctctttgggaggtgggctggggtcctcatcactatggttattttacaaggttggaccttctctagatacctgatgaggccacattcaggtgggtgggtagagacacactggtttcaaacatgggagatatgactgagaaggcgatgattgctcttgctaagacaatggacttcggtggtgatgggagaagcttagtttagatgcaagcaagaatgtgctcagatggagagagaagaaggaattacagacaaaagaaatctgcagaacaccaatttttaaatctacacctatgagggatgatttcagtttgtggcctgaggagagagtgggcagggaggaattggaaattacggctcttccttcacattcgtgattcggctaaatgggtgctcattattcagagaatgaaaaaaatagcagagcctggtaacacaagagcccttttctcaaattatcagtactttataagaattctagcttttcaataatcatagttcttatagctttatgttctcacattctaagtttgttgtggtgaaaagaacaaaataagggaggatgatgagttcatgtctttgtagggacacggatgaaactggaaaccatcattctcagcaaactattgcaaggacaaaaaaccaaacacctcatgttctcactcataggtgggaattgaacaatgagaacacatggacacaggaagcggaacatcacacaccagggactgttgtggggtggggggtggagggagggatagcattaggagatatacctaatgctaaatgacgagttaatgggtgcagcacaccaacatggcacacgtatacatatgtaagaaacctgcacatgtaccctaaaacttaaaatataataataataaaatttaaaaaaaaccaaaaaacatatttggggagaagcttccaagtaattaaaaaaatttttcctttttaaaaatttttgtgggtacataatgcttgtatatatttttgggctacatgagatgtgttgatacaggcatgcaatgtgaaataatcacaaaacagggaatgaggtatccatcccctcaagtatttaccctttgtgttacaaacaatccaattacactctttcggttattttaaaatgtacaattaagttattttaaaatgtgcaatttattattgactacagtcatcctattgtgtgatcagagagtagtcttgttcattcattcttttttttttcagacggagtctcgctctgttacccaggctggagtacactggctcaatctcagctcactgcaaactctgcctcctaggctcaagcaattctcctgccacagcctctgagtagctgggattacaggcatgtgccaccacgcctggctaacttttgtatttttagtagagacggggtttcaccatgttggccaggctggtctcgaactcctgacctcaggtgatccgcccacctcggcctcccaaagtattgggattacaggcataagccaccgtgcccggccctcattctttctaattattattttttgaacccattaacaattcccacctcccctccagccccctactacccttcccagactctggtaatcatcctccaggtaatttgattcagaattttgtgtttgttttcctaaatcaataactactatacaaaacgctgtgaaaatggctactattttctttcttttgctccccacctggggacggtcccctgggtcaccttactcagcagttctccctctagatttgatccagcaaatgagatcgagtgatatattatagactctttaatcattttcaggggaattgggttgggatggaagagccctgggcctggacgtgactaatctgagggaactggatcagtatttttgggagaagcacacctgaggcaagaaactacccccaaataaaaggatgtctaaaatgctcatggttctctccccttttttggcctcgaaaaatgatatttattcagagaaaaaaagaagagaaaaaatgccaagaagttcacccattggctaacttctctgtcccctcctggttcttgccagccccccagggttgagctctggttggagtgggtagcagggctgcccctaaggtgatgtcagtgacatggttcaaatactgtctcaccacttaccaaggtatgaacttggggttcattaagctgcagttccctccatagcatcttgtaggggaattatttaagcatgtgccgtgtaccctagtgaattacaggcctcaataaatgttgaattaggtataaaatcctttcctttatgcacccttcaatcttaagacctattactgaacaatgataggaaattggtttttcattcaacagaaagcccaaggttggtcaaggtcatggtagggccagcatttgttcatcaagtttatagtcttctgagctttgaaaatgttggcagggagatcttaactgggatgagacacagagagatgaattatagtgttacttgagtaatctatgcaataggttgctgccatctttggaaccctcacttgtgaaataataagaaatatacatattgttctctgtccccagtccctggcacagagctcctaaaacccttgtaatttcctgagtgataggagtgctaggggaatttttttgttctaatgcttggcttctgctgaagttcctgagagagagctccgaatacccctgtagacagaggtgctagaattttttagcatttggtccttgaccccaattttctgacacagagctcctaaatcccttggaatttcctgggtgataggagcatcttttgttctaatgagatgactcttggtgggcacctggctagcccaacattggcctgttggccaggaaaatgaaccatgtgattaaaagtagtactactatttgatccagcaatccagaggaaaagaagtcgttattcgaaaaagatacttgtgcacgcatatttctagcagcacagttcacaatcgcaaaatcgtggaaccaacccaaatgcccgtcaatcaacaagtggataaagaaactggtatatatatatatatatatatatatatatataatattacataaatatataaaaatatatatttgtgtatatatatacatgtatacatgtatatatgcacatatatgcatgtatatatacatatatacgtatatatacatgtatatatgtatatatgtatacatatatgcatgtatatatacatatatacgtatatatacatatatacgtatatatacatgtatatatacgtatatatgtatacatatatgcatgtatatatgtatatgtgtatatatatacacgtatatatatgtgtgtgtatatatatatatatatatatatatatatatatatatatacaggatagaatactcactcagccataaaaaggaatgaattaacaggatttgcgacttggatgagattggagactattattttaagtgaagtaactcaggaatggaaaatcattgtatgttctcacggatatgtgggagctaagctctgaagacgtaaaggcataagaatgatacaatggactttggggacttggggggaagaggaggagggggacgagggacaaaagacatacaaatatggtgcagtgtatactgctcaggtgatgggagcaccaaaatctcacaaatcaccactaaggaacttagtcatgtaaccaaataccacctgtaccccaataatttatgaaaaaaagatttaaaatgaaaaaaagatttaaaatgaaataaaagccaaagcagcttacagtaaaaataaatagataaataaataaaaataaagtattggaactttcagctccacctcaacctccaggaagaagagagaggccgaaggttgagctaatcaccaatgaccaatgacttaatcaattgtgcctaggtaaggaagcctccaataaacactcaaaagcactgagttctagaggttcctggaaggcagtgggcttggagagggcacagaagctcctcaacccttccccataccttgccctatacagttattccccccggctcttcatttttatcttttgtaataccctttgtagtaaactggtaaatgtttctctgatttctgtgagctgctctagcaaattaattgaacccaaaaaagtggtcatgggaacatgggttacaacctgtgcttattatttggcctctgaagtggggggaaaactaagccctccatctgtggggtctgttgctatctccaagtagatagtgtcagaattgaattgaataagagaatacccagctggtgtctgctgcagaattgattgcttggttgaccgtgggaagaaatcctcacgtgttttggcaaccagaggtcacagaagtgttgattgttgaatgagaggatagaaaaaaacactttgttttttcttttctccatatctcatactactgccctgaggatgtcttctatacctctacttatagcacagcatcacacatgggaagcatggccaggtccaaaattggtcacactttcctctgacctcactccagctctttattcccttctgagagctcatctgagcataccacacatcagcatgtgtgcaaaactacattacggagaagagggatttgatgaatcataaaatctcacacagtactggaaaaagtccaggataaatgggctttgaataaaataaatgccaccagaacccccacataaatgatgcatgacatcgcctgcaaattgaggcatgaaggcatgaaattttaaactcccagatggctcctccttgttcttttcaacttgtcctcacaaaacttgtgcaatagctacacctctcaccactgaacctaggtgacacctgaggttcgcttgttgctgaaaagtagactagaaagttgagtcattggggaattgaagggaagatccatggtgtatttcccccgtagcccagcatctaatacaaatttgggacacagcaggtctcagaaaatgtttttggcatgtttacaaataggaagaagagctgcctctgttcaagagaagttaagacccatcagatatctttcattcatgatatcccagtcttatgttggggtgatttaaaaggttaagtattggctgggtgtggtggctttgcttgaaatcccagcactttgagaggctgaggtgggagaattacttgaggccaggagtttgagacaatcctgggcagcatagtgagatcgtatctttacaaaaagtaaaaaaaagttagccaggcatggtggcatgagcctgtaatcccagctactcaggaagttgaggtggggggtgtatcacaagcccaggagttcaaggctggagtgagctgtaatcccacaactgcagcctgggtggcagagccagggcctgtcacaaaaaaacaaaacaaaacaaaaaacttttgcagccttttaaggaggcaatgaagtgggctttgatccagataggctggagtttggtgctcaactctagaacataataggcataaaatctctgaaccctggttttccagcactgaaaggatgataataatactaagagtaataataattgtggtataataagaaatattatttggtttttgtctgtggttcttgccacagaatttctaaaactcttgggatttctggcctggaatatgtaggcaggaggaatcttaagtaggatgggacatctagaatgaattattctattgagtaatctatgcaataggttcctgccatctttggaaacctactgcagtgaggaagtcttctgcacttccttttatagcacagtattatatactggaagcagtggacatgcctgaataagagtatcttttgttattcataatgaacacttttaatcatatctgagtttatgctaatgaggtgacttaaggtggggaccctagatagcctcaggaagaggctggtcaccagaaccaactcagtagagggttgaaacttcagtcccatccaccagtctgaaaactggagatataagctctataaaaagtcttgaacaacaaatgtccatcaacacataaagaaaatatggtatatatacacaatggaatactatacagccttaaaaaggaaggaaattatgtgttttgcaacaacatggatggaactggaggacattatgctaactgaaataagccaggcacagaatgatgaataccaactgatctcacctatatgtacaatctaaaaagtcagtgtcatagaaacagagtagaaaggtagttaccagaggttggtggagagagggaaggagaaagggtagaaaatttcaggtagactgaaggaataggttttagtgatctattatgctctgctctatggtgaccacagttaataataatgtatgtatactttaaaattgctaatagattgttaacattctcaccataaaaaaatgatgtgaggtgatggatatgtcaattagcttgatttactctttctacaatgtatgcctagatcaaaacatcacattgtatcccacatatatacacaattattatttgtcagttaaacataaactttattaggctgggcgtggtggctcatgcctgtaatcccagcactttgggaggctgaggtggacggatcacctaaggtcaggagtttgagaccagcctggccaacatggcgaaaccccgtctctactaaaaatacaaaaaaattagcctggcatggtggcgcgagcctgtgatcccagctactggggaggctgaggctggagaatcacttgaacctgggaggtggaggttgcggtgaactgagatcatgccattgcactgcagcctgggggccagagtgagacttcatctcaaaaataaataaactttattttatttatttttgagacagaatctcgttctgtcactcaggctagagtgcagtggctcactgcaacctctacctcctaggttcaggtgattctcctgcctcaaccttccaagtaactgggattacacaggcgcctgccaccacacctagctaatttttctatttttagtagagatgggtttcacttgctggccaggctattctcgaactcctgagctcaagtgatctgcccactttggcttcccaaagtgttgggattacaagcgtgagccaccgcacctggccagttgaaaataaactttaagatgtatgaattaaaaaaaaaaatcctatccatctggtgaggggtcataattatttttaaaaaaagtcttcgcgagatttgatgagcttcccgattggtgaacatattgaggtgctgagacggtggtgcacccaaagaaggcctagaagcttcatgcatattctgcatattcctcgcccctgccctagtcctgctgcaaccttacactgtgtacctgttccatgtcgctgctcctgagttgtatcctttataataaaccagagttattatgtttccttgagttctgtgagtcattctagcaaattatcaaacatgaagaggggttgtaggatttatagttgcttagtcagtttgaggcctagacttatgattggcctctgaagtaggaggagtctgatgtaactaaacactttaactcttgcgatctgatgttaactttaggtagataaatcttagaattgaattaaattgtagaaccgtcagctggtgtttggagaactggagaatttgctggtgttaaaaaacatataataataataataatgaattatgcttttacagcatgatttcagagacagctgaattgtctaatgcaccgagagtgactagaaggcaatagcactgtatgaatgcttattctccctcatgcctccccagccacttcaatgatctggcctaattccagtggcccacctccttgctccaacattaaggtccattgcaaatttgtaggtgtgtgtgacattttacccttaagaagcatcttttcaacaggactgatatgggtatcctgtaatctggttctatttcatgtgttttctaagttttctttaattgaagaaatgagaaagagggatatatttttgcagtcacagctcatgtaagtaactctgctaaacagtaggttgtgtgatggcctcagggccccctgtccccttgctcctttaccaaaattaacagtgtgccatggactttcatacagtttcttatttgacactcacattagccttgggaggacatttcaactagacatattatcactattttccaaatgagagaatggaatctcagaaagacagactacagtaaaagaatcaaagcatattaaacctggagggcatttgggagatcatgtggcaaaatccctccattttatgaagggaaaatgaagcctggatcaggaagtgatttgcccaaagccacatggtcactggtagaactgggttaaaaacccatttgtcttcttactttggtactttctcctttggttatatcatctaggcccccagtgcagattttcttcatagcaaatctagggtttaccatcccccgtccctgccaataccactgtctgtaaaatatagactcctcctcaagttagtttccctcctgttgaggcaaagattggaaaagtgtaattagaccaacaacactcagctttattaatgagcctttcaagatgctgcctgcttcccatgtgtgggactggaccaaatgggacagttgcccaataagagcccaaggaaagaagaatgtgagggatgagtcaatcctgggcatgtgcttactcaacctagactagcacatgtagttggtgggagaacttgaactgtgacagggaggatcaaggttacagctaaaaattagcgctgaatgtcaagttcaaaaggtgaggctagggatgaaattggaggatgaatcatgaagttgaagccaaaaggttcaagaaaaggatggattccgtatgagaaacgtggttcagaacctaggatgtgaacacttggtaagtgctactggtgcctgggattggtgcctgggatgtggtgatgggtaccatgcaggacaagacggcatctactgagtgctcccgcagatatcatctatgggaaagacacacactttagggaaataacattgtataatatcaaggaatgacatacatatggtctctggggaagctttttgaaactcagttcatctttcctttgatggggaaaaagcagaattagactgaaatcttttttagcctacttgtcattcagatagcatgcttgctgacccttttatctttgccgaaatcagaatccttcatgtctgctgcatgcgctgtgcaatgctatctggacttcagtgtgaagctgtttttcccctctgccctcttttccatctgtcctcacatttctgagtacagattaaaagccttgcactcattagctggggcaccactgcagccagccagcccatgtttactgggtgcccatggggtacctggcattgccctgggcacctgcgagagaagccaagggctctgacatcccttgccctgggttctggctcccaacggtgctgcagggcagatgaacaggcctgacaaatagtaatcaggaggatgaggggggactggaagtttggaattttgagggggctggagaggaatgaggttttggatagaattagaaagtgtgagattcagtaaacagttattttaaatgaaagaaagaacttccagcaagtgcagtttctattactgtccttgcagagtggcagacacacccattctcatgaattctgtaatggatggaatatgaaatattgccaaaataagtgacattccttggttgggagatgtattgaggctatttggttctgcctgcttatttcctgcttaaggaaacttttccatatatgtgcttaggagggtctagttgggatatgcactttcaaataacctgaatgttcagaatgggctcactataaacaccggcagttgccaacaaaagtataagatgggctagaatttccatgctttggatgaggtaaaagaggcccaaccacttctgaatgaaaagttattcctcactctgtctttgcttaataaaactgcactcactctgaacttcagaaatcaaaagcagctttgatttgttggggtggaaaacggtgggtaaatttttcctttttttaaattttgttttctcagaatatcattatgatatctgtgcaatgtggaaaaacaattatctgctctctaaagagatgaaggtttgcaactgaaaatacaatgtaaaagagagtatttctcttcctgacttgagaatgaaactaaaccatgcctatccctgaagacccagggaaaattccattccttccatgcaattcccctcttaaatatctttgtgcttccccagggcgcagcacattggtgtgagtctactggccgctcagtaaatacctgaagataaagggcatagtaatagctaatgtagtcataacagttttcactgttgagtgcctacaaggagccagctctggtaggagcagttttatggtcctcaacagtcaccatatgcattccttataatgagccagcaaaaaaggaattatatccaatttcacaaatagtcagcctgagactcgaagaggtgaagtctaaggccacacaatcagtaaatgacaggactgtaatctgattccaaagcccctgctccatgtagatatctcagtggcttctgcacaggacaggacacaagttgctgtgaccagctggtgtgcttctctttatttgcacctggacaggccaaggattgatgagtgggccggagcccctttgaaaatagcttttgaataacccatatgagaaaggaccagtaagttggcttggtttcttggttttctcattgctgtcggcttgaactttaatagaatgcacaccttcctcttttttagtttcactaaatgtcaaggttacatcagcgtgagccacttacttttcagggagggaagtgtgtaccactagtggcccagcatatcaacaaggcaaggaaagctttcccagtaaccctctctgtggcagggccagcagtgcagccctcttgggtgtctccacacatccctaggatgtgggagagggcaaagggaggtacccagtggccacttgctggctgattgataaagaatgatttttggtttctctctccttctccagcatcctgggggggtgtgtcagctcactgagagagaccctttttctcttgagatttctctgccctttctctgcacccatcccacatgcttgtttctcaggcttgagtagaaggcagatgttcacagtcagctgtaatgggccctgggcttgctctttatacatatatgtgtgcacttgtgcattcattatttattgagtgcctactctatgctggacactgtgttctaagcgagacaggaaccctgaactgtcttgggggtgggaagaccctctaggtacaaaaaaatgtgaagtgtaatgagaacacacttacacattctgccagagccccaaagagtcattcacctgtcggggagtgaaagtagtgatgctggtggggttggagaagtcttcatagctcaggtgcacatttaaactgaatcttgaaagagaagtaggatttgataggcaaacagggcaggaggatggagcgttctgggcagatgaatgcctatgcaaaggcctggataaacgtggttttcagagaagaaactgggaaatactcattctctgtttatgtaaatgtgatgcctcctttaagtccagcacgagtcccactttctctgagaggctgatctacactattccaggtaaccccttgctctccttttaaaataatcctgatgttggtcaaaggattcaaaatttcagtttagataggaggaataagttcaagagatctattgtataacacagtgactgtagttaataacaacatactgcactgtatacttcaaagttgctgagcgagtagatttttaagtattctcaccacaagaaaacgataagtgtgcaagatgatgtacgtgttaattagactgatttaacccatccacaaaataagcatatttcaaaacatgttatacaccaaaaataaatacattttaaatttgccagttgaaaatttttaaaatatatataaaaaaatctgtagcattatctgtctatacttaatcaactaggccttgtgttgttacttaactctccaatggatatctattttttccccttaactatactggtagcctttggaaagcacagagcatattctatatatattctgttcccctactatgacaagcatagaacagagtacttaaaaatatttaacatgtatctagaatgagccagaaaaagactttagagatttttcagagaactgccctcatttgacaaacaagaggctcagaaaggggaaatgaactttaatgaaatcatttggtggcacaggtgggatcagaactcaggtcttctgattctcagttagtggcctgctggtttcatcagctgcttccctgtttgttgtaggcagctggatagatggacatcatgggtgtgtgatgcatgtcaattgcagccttgtctcaatgccacccactcttcagctatttgctaaacctcttcatctctctccctgttgcctccacaccatcttgggggaggcaagtttgtattttcaaaagtggagactcctcagcaatggactatctcctaccagagccttctgaggacacctttcacagagcagttggcatttgtcgggggtgaggaggaagggagtggagaggatgtaatctcctgctttcacttttaattcttcaggaggaaaggtcttccccccatctctgatgagtgttttcagagtaataatcacctgtggagtaggaggggtatcccacacatttttaatgaacccagattaatgagatgtcaccaagacgatttttttttttactttaaaatgaagtttcttttgtctcagagcctttgattcagaagatctttatgaacagagatggctccatgtgagtgatgcccagaaatgccttgatcacatacagtggctcatgtgggtcctgggctaagctgtcactttttacagctatgcctcaggaagtgggcagtccttctcctattctaaaaatcaaaataggataataatgatatttccttacatttgtaaatagcaacttgcaaagtactttgagtttgataaagcactttaaatgcttcattaatttttttaaagatgctatcactgattttacttcatgtccatcctatttatttatcaaatatttattgagtgcctattatgattctaaacattaggaacacagcagtgaaaaaagacagacgatgcccctgttattgcagaactttcttttttaaaaataaaagacttttgcagaactttttttttttaaagacttaaaaaaatttttttaaggacggggtctcactgtcacctatgctggaatgcagtggcatgatcatagttcactgcagccttgaacacttgggctcaagcaatcttcccacctcagtcccttgagtagctgagactacaggtgcatgccaccacacccagctaattttttgttgttgttgtttggtagagacaaggtcttgctatgttacctaggctggtcttgaactcctgggctcaagtgatccctgccttagcctccaaaatttctgggattataggtgtaagccactgtgccagacctttaaatactttttattttgaaataattttgatctgtagaagagttaagatagtacaggaagtttgcatataactttcatccatcttcccttaactttttttttttattgaaactaagaagttaacattggcacaacactatgaactaaattagagactatgttcagtttctactactttttctactactgtcctttttctgttgcaggatataatccaggatctcacatacaattagttgtcatctctattcagtctcctccaatctgtgatagatcctcagtctttccttgcttttcacgatcttcacacttttgacgggtacttatcagatattttgtagaatgtccctcagtttatgtttgtctgatgctctcttacaattattctgggcttatggatttttggatacatatcacaggggaaagtgcccttctcttcgcatcagaggtacccaatatccacaagacgtccctggtgcagttagctttgatcacttggcccaggtggtgtctgccaggttccttctctgtgaagatattattttccatttgcttttctttggaaggaagttactaagtcctgcccaccacactgaagaggaggggaattagcagagcttgcttttaagtaaaaggagatagaaaataatggagtaaataaacatgaaaaattatcaatgaatgatcagttttgagcagagaatcaaaactaagtgatgtgattgtgagtgactgggtggttagggacagtttcagctgatatccaaataataaggagttggccatgaaaagaccagggggaggagcatgctagagagagggaacagcttccagtgcaggagcaaacttggcatgatcagaccatgcctctccccttttcaaaaccctccagtgactcccgttccaccagagggaaagccacagtcccaacactggcccacacaatctgcacaatctgtcccccatttgacctctagccccaccctacaccttgctattcctcaaacacaccaagcacactccacacttaggccttggtgctggcagctccttatggagaaactgttctcctttttacgctcatggtcatctccctcacttctctaaggttttattcaatgtcatcttttcagatgcttaaacttttttgtgtgtgtgtgtgtatcaccacacacacatgcacacacacaaacaaacacacagtgagtgagtaggtgccccagtccctagaagtattggcacgtgggttagagggaagcccactgcatatggacttttcatatgggcttggaaactttcttaagctaactgggcatgcttgaaaagccaataggcaactgtgactctttagcacccatctccttaaggttgtttttttctgacagttatcactgccaagttgacaagcaatcaattcctttgctccacgctttagacactgcctaaatttcaggtattagcaaattcttctgctccctcttcatttgctggtgactaaagaggcatatgcatcatgcctcctaccagctggcatgagttatatgatatcatatagtttctactaaacctcatacatctctgctttctctaatgaggtggatgtggatattgaggttgcatttcttttcagagaaaataaaaggcaagtcaatccatgtggtcagataaagggaaataagtcttgaataggaatctctcctaaatggccaatgaatcagcatagaaaatgcatcagtgaggcctaagttagtaccacaataattctcattttacagatgagtaaactgaggcagggagtggtaaataactttcctaaggctagtaccaggagcagagccaagagtcaagtctaagcaatctggatgtacccacaatcctctagcagtggctccagtgtggaggactcctattgtagacagtgccttctcctagcacaacatcagcaaagaaagactgtaaatatctccttactagaatggaagctccctgagggcaagaattatgaattactcataattgaacctagagattggcaaaataattcacacagtaggaactcaaataggtatctgtgaggaattaatattattcattatacagagttttggattattcattattttggattagtcattcttctgtttctttgatgaggaaggcatcagagacactggtcagactgtaatgtaggaatctattttccttagttggattccttttctacactttttgggcattatttcctcatagaaatgttttgtaaatgtggccagaaaatcaacagggacttaagggaggttaaaggaattaacatgtgtttgcaataaagcgagtcatgctatagctaagaaagtagtggttttgtaaattaaaccctgaccccagctctgaactcaagcaaacattctttttcctttagaaaagaaatcaaatacatgccagtatgaaaaaaatgcatcttccatattaaaggtccactgtaactaaacttttaattaaaatgagcacaaaaattaaataatataacctgcaatgttgatgaagcttagcctctgtgcaagaaagctatgtgtttctaacctgttgacatttttcaaaacattaataatgggaaaactatcccagtggggatatctcagacttaaatattcaaaaggtttttggaaagtgtcctacatctgggactgttaaaaagataagtcaacacagggataaaaaaaaaaaaaagtgcttgggttgttttagtaccttggaaaggaccgatactaaatagagttgttatagaccaatctcctttgcccggataagacggtccctgactgggtgtggatgacagggagctagaaagattggctgaacatgatggtgcacacctaacaggctccatatcaagaaagggaaatggggccaggcacagtggcttatgcctgtaatcccagcactttgggaggccaaggtgggtagatcatgaggtcaagagatggagaccatcgtggccaacatggtgaaaccccatctctactaaaaatacaaaaattagctgggcatggtggcatgtgcctgtagtttcagctactctggaggctgaggcaggagaatcacttgaacccgggaggtggaggttgcagtgagccgagattgtaccactgcactccagcctggcgacaggacgagactccgtctcaagaaaaaaagaaagggaaatggattctggtcaatgagtaatctggaacaatataaacaattctttttgctctgagttctagaaactgacagggagacaagagatgtggacatatctgatggacaattatgttagaaaacttcctttggtggtggggggagtccttgttttaactattctgtccctatgttagaccacatacctaaagtccgcatttttaaaatctatgacatctcatcagcctactactggaaaagacacagaggaaaggggctggtaaaaaaaaaaaaaaaaaaaagatttatttatttatttattttgagacagggtctcactctgttgccgaggctggagtatggtggcaagatcttggcttgttacaacctccacctcctggattcaagcaattcttgtgcctcagcctcccgagtagctgggattacagacacccaccaccacaccgggctaattgtatttttagtagagacagggtttcaacatgttggccaggctggtctcgaactcctggcctcaagtgatttgcctgcctcagcctcccaaagtgctagcactctgtgccagatccagtgctaaggttatctcatactaactcattttatcccaacaacagccctttgaggttgacatcattattattattattaccattcttctcactcaggaagagcctagataacttatcagaaggcacacagtaggtggtagagctgtcattcaaatgtgcttgcttgaagctaatgttaacgcctgagcaactcatctgagcccaccctgtgatttttacattgactggcagaaacgaaggagagggagaacaatgttagcagccaggaagatgagtcacatggctgtgatgtgccactgagtccctgtgatgaggaagactgttgtgacactcaattacaagatgctaaattctttgagtgtacattatggattgcttatagttattctttctattaatgggtgacactcctgtttgtctgggatgcttttatcctatttcagttatgttcatgcttctctttcaagatccggcttatgtcagaaagccttctccatccccctaatttgagtcggatgtgtcaacagcacttgagcttgtgaattttgtcaggctgatctgaatagaactgtctatcttcccactgtggcagacatcttttagggtgtctgcataaccgacagtgtctgccttcaccagataactgttctccccaccatacaggcaggtaaccaagacctatttatctacctcatcccacatggatagctgattgggtcagagaggacatcagatcctctcggggaaaaccaaatttcttctttggagaatgtggaattgggataaagagccagacagctagtcagtacaagaaggtcttgcgccaaaggaacataaacttgggagctgaagtgggaccatttctgccctctatatacacagaaaataaaaaataaaaaaaagacagctcatggggagaattgagaataaggccgtcatgcagagatgggcaatggagtaggagtgagtccctggcttataaccttgtttcagttttggcttccagttccttcatttgtccagttacccttgagttctatgacatatcccaaaggtattctagtaaatcccccttttagtttaaccccatttgagtgcgtttctgttacttgccccccaaagcactttacctaagatgccgtcaggaactagagcccccagaggacagtggcaggatttgttcttgggtgcagccctaaggtagcacagttcctggcttagttatatgaatttttgttgaattttactaacttaatatagcttttctatgagatagcaataacactacctggtcctccccaaattgccacacgctccagggaattagatgaattaaagccaagggctggctggctccattgaaagccacgcttcgcctcactgttgttccgtctcgtttccagtttgagaaggcagggaggctgggaagctgaaaagcactcagaagacagggaacagcaggagaaagtgacaagcgagacaggatttgaaaggggcttgttttgagtgctttggaatcaacttgttctttaattaagggggaaatatcaccctccagctagtaaagacacccctaagaaaattaaaataatgtaaatcaagctaaatgaatactccagaagcggcactagagctttgtaggattgagtgtttggatgcccctgaggttttaaaagcaaagcttgcaactgctttttggagcagaaacattctctcttttgtttgatggcaaaggaggctaaatgccgacaccaataggattcacggaggagttggaggtgacagaatcttcttactgtttcggctctctaaagaccagaattgaaacaaaacctaagtagatgatgctgataaattcctggggttgcttcctaggggtgttcaatgcaaagaaatcatttaacttgtaattaattctacaaagcaaaatggttcaaggggaacctagagtttctagtaaaataccttattaatcacaggggcgttttacctgggaggtgcaaaatgactgaggtgtgatggggtttgtgtgtgtgaaagctactagtatggtagtggcaggagcaggaggttcaatattgcgacaagaaaaggtcgcagatccaagtgagcagaacaatctgagctttactttttcatcaaatgtcttaatttcccaagattttaccttaaaggaggtatgaggatggttacaaagtgtgtactcaatctttggttggggggggggggttccaatgtaacacaaataatttattacacatcaatgtttctgactctcaagatagcatcatgactccttaatcaatggtttatacgtgatggcaaacttgtgcaagaagattttacttccataggcctcttggtgctggaagagctactctagtcctttcatttctggatgaaggaaaagagatctagagagattaagtggcttgccaaaggtcacctagtcgtagggtgagcatatgattcattgtgcaaactggaggacttttgaaggtgaaaggatgtactataatattacagttataccaggacttaactggtgtcagactggactgttcgggcaaggcagggcaggtgatcatcctatttagacagctcagggctttgcttcaaactcacaaggaatgaggaatattctatttgcgggtcttctttgcaataataaactgccatctgggggcagggaagggcaccacctggaggccaggaatgggagggcgattccttgcaggacctcaggctgatgggttttctccacaattaagtgtggttagtaggggcttgactgtcttctgcaggcctgagtgaatgtcttagtccattcatcagaatatctgagatggggtaatttataaagagcagaaatttatttttcaccgttctggaggatggggagtccaagatcaacacaccagcaggctcagttctctggtggaggctgcatcctctggaggggaggaatgctgtgtcatcccatggcggaaggcaaaagggaaagaaggaggaggctttttctcctggcagccttacagcaggatgccttgacactgataagaaaacagcattagaagggcccttaacccatcttcttagaataagggtttcaggaaccaactcacaactgctcatgtaatttttaagaatttcaccttctgcatgggtgctactctggattcttgttagatatggatggaggatagaaatgctgaccctgtatatatgcaatgtggaatattacacagccataaaaaagaacagaatcatgtcttttgcagtaacatggatgcagctggaggccattatcctaagtgaattaatgtaggaacagaaaatcaaatactgcctgttctcactcataagtgggagctaaacgttgggtactcaatggcaccgacagacactgaggactactggaggggcagggagagagggaagcaagcgttgaagaactgactgatgggtactatgctcagtacctgggtgatgggatcatctgtatcccaaacctcagcatcgcgagatatacccaagcaacaaacacgaacatgtaccccccaccccgaatctaaaataaaagttgaaattatttggaaaaaaatgtgaaccacagatgatgcagcttgaagaagcatgtcattgctaataaaaacaaccatttttgagcactcattctgtgcaaacaactattctgagcactttttatacattgatccccttaatccataaaactactctgcaaagtgaaactgttctgtctcctgattgtgctgatggtcatccaaatctatatacctgttaaacttcagagaactttatgccaaaataaaaaagttaattctactgtataacttaaaaaacaaagtaaaaaaaaaaagactatatactgtataagtccacggattgaaatccaggaaaggcaaaactctagtgattgcaaatcagtgattgccggggctagggtaggagggaaggactacagaagaacacagaaactttttgggttgatggaagcgttctagaccattttggtcatggttacacaactatgtatttgtgaaaaagcatcatattgtacagtttaaattcttaaattttttttgtatgcaaaccatacctcaacaaaactgggggaaaccaccctgtagaatggacatcactcatatttgtcccattaatgaggaaattggggcacaaggaggttgaataaattgcctagggtcacagctgatagagccaggattcaaacacaggaatgaataattccatcaattttcacttccacaattaacagctgctcatgcaagtaggtcatggcccttaacctgggtcatgggaacacattagccctagagaggcagctgcaacaggtagaaaatgcttgacccccacagaggactttacagaaacagcagctgttccgggatgaccatttgagtccacacacaattagtctttcccaaagcagacacaattacttgatttgaaaaactggtgccaggatgctaagtcctgatgcagatatctggtggcccctgggccttcccctttttcctggctgggagtgtgatttaaaacctcctggctaagctcattttgccaaatagctcctgcaggattcatttccaaggctgagtccagaaatttctagctcagcaaatagatccaaagcaagatgacgaattcacccaagctacctctgagactaaggaatatggtttcttgtgctttgcagaggcaaacagatgtgtttatacacaaatttacacacataaaatgccttgcttgttataaagaagagagaaaaaatgtaactgtacatctgcatgtacagtagcttccatctgggaactgtaacttcccagtagctgtccatctgggaggagaaggtgaatgaaggaatgaaggtcctccgcaggaacacagaatgatgctgtgtcatatttcacaccgctgctgtactacttggagaaataggctcctgtctcactttacagctagaaacagtgcagactgttcttaaggctgatgcagaattgagaggaactggaagatcatctcaggtaacacaatcaggcacttatgattagaagaatggacttacccaggatcaagcagctacttagtggcagagccagagaggtaaggtgactgtctaaggtcactcagtgcatagctggagtcagagacctgggttctcttccctggaccaaccatgcaactgaaagcaggttctttaacctctcgaggtttctgttccttgaatataaaatggtgctaataagtgctagctcaaaagcttattgtgaggactgggtgtgataaggccctaagcacaatgcctgagacacagtacatgctcaataaattacagctgatggtagaagtcattttagttcaccgtggttatgctaatgtatcttatcttcagtttgggctagatgagttctaaggtgaaccttagaacttagttattggctagccaataactaactgacttgtacagcactttatggcttaaaaagccctatcacagaagagttttctttgcattgcacaattaccctataatatatatatagaaccagcacaattagctccatctcccagtttaagagactcaaaaagccaaagcagtttactgaattctgccttttccaagatcacacagccaataagtggcagagaggagtgctgaagtcagatcttctaagtcaaaatgttgccttctgtctggtggcccaagtgtccaactcttaggccattgtccttcccttagtgtgtttgtccctgcttccctacagccccccttccaggccaagccaaccattgctcttggagtgtgcctctcaccagcagatccaatgaataatcatgacagtaaccctactgttgcccttttactgcagagatggggatagatttatagaggctgactgtggctggtatttgggaatggataatcaccttcacttactatatcctaggctgcttcggctaaatatttactgcccagaattctgccctttccaaccaattctgaatatgagcatggcacaggcaactaagtggcataattcatttggggcaaccataaatctaaggcttccaccagaaatgatgcaaaaaattaatggaacatgaaatcaagtaaatggaattgagtacagtaattagttcatattttaatcctcaggtctgtttattatctgtcaactggcgagcaattaagttggcaccattgaaatgattagctttgtttcagcaaaagtttatcgatatgtcagtgcaaatggatccggtggttttaaatggccttattttgaattgtagagcagcacatccatggagcagctagacatcgaatgatttaatttagcaatattatctggattacttatatttaatattactgaactgttctggagggttatgggggaatgtgggcgggggagatttaaactgcacaaaagcattgcttctgttcttaggttcttaatgcaatagtatgattgccttttcatattgagaccaaggaagaacatttaagacactatattttagtcttccaatctttaattctcacatttatctcaatcaggcactattatggctcgctctcacattggtggtcttttctcaggggtgatttggtgatttctagatccacttccttgtggatgctcatcatggcttatgttttgtgaaataatctcccaatgtctttgctgttttgaggctgactctatagatgcccttgcgatggggctgtgctcacaaatgcaggaaatgtgattctcaggctctatttgctctatgaggtgactaaaccaggtgacctaagaaggttttttgaatcttgggatttgacagaattctaaattttatttaaaaagttaaaaatccccaattaagagtcaggaaacttgggttctggtcctaattctgccgctaaatctctgtgaccttgggcaggtctcttgccctttctggcatttgatttttcctttgtacacacagggggtatgctggaagagatggcctcaaaagttcctcctctgacactgtcactttagatggacacttggagtagacttgtcctttccaagtccaggtctatgtctggaagtgagagatgtgacctttcgtggaacctctacaaattttcattggccactgatagtatcagagtcccaacgaatataggtcattcttatttaacacctctttttcaaattgattttattcctgcagcgttggaaatgagttaaaaaacacagctagttcacggaaatgttgtgagcggtactcatgcctgtaactgcagtgtcactggttactaaataaacgaaggcctcattcaacacttgtaaaatgataatagccatggtctccatggtgacaggtctgaggcagaaccctgatcaaattccagttaatgcctgtctttaatattgtcttttgtaatgtaacaccttcctcctttcttccgatgaagcatcagcagggagatcagagtcaagtggaggaggatggtggctgtcatatgccatcctgggggtccaggccagagttatgatgcagattaggctggagtcaatgggataatgagttgaccgcaggaggctgtcttctaatgcaatgccctctctcttaggctgcactagtgactatccaatactggcaattcaggaactgctgacttgattgggctgtgctttcccagaagtaattataaaaatgtccagagggagaacttcctctccttagatcagagtcatcatatgcttgctggtattgctgtaatgtgccctaccaccatctgagcttctgcctctgctttgcttctcgaaggccagtttgctcactctggtgggactggctcttagaatctagaaatttgatgtctagcattggcaaagctccttagtctgatcctaggagtaattccagggctgaaatgaggaatctaaatgaatttttctggtacacaggttctcaattgttccattatttctcccaggtactccgaatttacttaccttgtatttgtgaataatttaacataaaaaattctagaacctctgttaatattgacaactttattaggtttgccattatgactatacaatttaattcatgatctattgggtataatctaggtactttgaaagctacattcttaaattatcttcatttactcatttaatctctactcagcaatacgtaccctgtgcccattatgtgtatggggagatatttaaaaactacaacatactctgtgactgtagggagttaacagtctgattggaaagacaggatcctctactatactgtaggctccttacaggtaggcactatggcctatcagtctttgaatttccctaccaagctagggcccagagcagatgcgtaatcattcgtattgggtttatggataaattgtgggctatattaggcagtgttatgaatcagaagacccgaactaagtccaatcttggttatttattgcctggatggtcttgggcctttgtttccccaagaaggtggtaacattgagagcaaccgccttgaggtttatgatcaaatgggagaatttctgtctctgtgctttggaatttattcagagtaaaaaccaaagtccatacaaagtgcacatagagaggacccacgtggtctgcagcagcctctggccctgctctgacctctccgacctccttccccatcactcacacatgtgctcatgctgcttccgctcttccttgcatgctcacagctccctcccacttcaaaatcatggtactggcgattgcctctgcctggaatgtccttccccagacatctccctggcaacctcacaaatgtcatcttctcactgaggcctatactggccacactatttaaacttgtagctcactccttccactcctcattctctgatctctcttgttttgctctagttctctctccatagcatttatcatattctaaatttacatgtaaatttactcatttattatgtttattatttattatctgtctccccccgctagactataagcaccttacaggtagacatttttatttgttttattcactgtagcacataatagacaatcaatatttgttaactggatgaatgaatgaaggtaaaccacaaagcatgtgaacagtggccaagtgttggcagtgagattctgcagccacctatgggcatgactgggtgagctctagattgtgctgcacagtaactaactcaagtctgtgccttgtccttccagtggctcttaaatccctccagggtagcgcttaattgttcaatccttttgtgtcctttaccacatttgggatagggctaggtggggtgccttctaaatacattttgaatttctgaaagcatatttctttcccagagaaattccagaacatgtcttagtagtaactgcaaactgaaccactcttcctcttttacagtttctaatggaatttaatgctttgggtagccttcatataaacactccatcttcaagttaaatggggctgtatatttctgtatagtgaatggaggcaacatactttagaatttcagggaaaaaaatgcctataagatttttgttcctgggacacaaatggttgactgagttgttgattcagtggtttaatgactcattccacaaacaccacttaagcactgactgtatgtcaggcactgtgctaggtgcatggcatgcaaagatgaataggtcttgtccttaagaggtttaccaaggtcatttattccctcattcagtaaatatttattgactatcctcaagtccagacaatgtatgaggtgttgggaacacagcaatgatcaatataaaattcccatcaacaaaggactatggttccaatagaagtgagattaaacagttacaaaacccacagtgatgggcaacataatagattggggtcagctaaaaaggccaggtagtaaatattttggcttctgcaagctgcatgtggtcggtcagtttctctctttttaatagcatcctttaaaaatgtaaaccattcttagctcctaggctggacttggtccacagggtatggtttgtaaacccctgtaatagatgaatacacaggatcctctggaagtcaaaaggaggcagcaccttcctgtctgggaggagagaaaggggcttgggaagctatgatggggaactgtggtggatgggggaagggagatggggctggcattcagagtagagggagcagcttcaccatggcatataagtagcacttccatatgtattgtccatgtacctgtccttatacatcccaatcctcatttcctctcaatctccaattgtgtcaatggagcatctctaccaggaggtcgtggcagagcagcaaagtgctaattacattgcctgagcactcctcacaagccattcattgcctaatggggccctggctctcaaggatgttctcctcagcacttttcataccctagcacacttcaggacaatttgatgttagttgcttattcctacaaatttgtgttgctttagtgaaaccagcctctcaaggatgcaaataattgattcctggaagaggacaaggcctgcattttctgttgttttgtttcagttgttggttctgagataattgttttctcttttctgattcagagccactgagagagagagagaaagcaagagagaaagccccatattttacatatgactttaattctccccttttaatgaaacacatcctatctatatcaccatagcaacagctatggacttttccctctctcagatgtgttttgagcaggatcagagattccagaggctgagagctagcaaggtcaaggtgtttctatcttgctgtcagagggagcagcaagtgggtcaggttgcacagctgctcacccattctttgcttaatgctatctagtgagagctatttcataatccccttctggaataagcttcaaatataatccacattatgtggtattatcaatatacatccctcaatagactttacacatctgtgggcagaagctgcactctggcccatgcctagctcggagcccaccacatggcagaagcacaagagcatgtgaagagtggatgaaattaacaggaggaactggctatagatcttgcatgaagtggctggtacaattctccgtgtacccttctgcccccttgaaaagaagaacttaaggaaggatttttaaatgaacttgtctaatgtatcccaaatcaggaagattcttcttgtccagcccccactactgcaatggaatctaaggcatgtttcttttcaaatattattttttccctggctaatgtattttcttcttttcataaatatcctactttatactggacattaatctaaccatttagacatgattagcaagctaagggtcttacttattaaaaacagttcatttttccttcttaaagaaatggagacatttgaatccctgaatgtgctcatttatcaccaatccccaacaaggaatccaggagttctctgtgtaggacatgagtaatttttataaaaatgcagttgctgactatgtcatacatccatgcagctttataaaacaaagcaaatgattaccatcaattacaataacctcactagacaagactgcaattaatctatagctcttcagataacgactgttgcactgtgccaaggaaaatgcctggcattaattgacttatcacgatcagcagtgatagatagggcagatggcaatgtgatcattcactgtcaacaaaataaacacatgctttcttgctagaagtgtctacttgggtcctctcaaaggatagccaaaaatagaggccaaaggtggctttgaaggtagcacaaaataaaaattaagttaaccagattcgcgcaatctacccacataacaaacctgcatgtgtacactttaatctataataaaagttgaaattcattttttaaaaagttaaccttcagggtgagatatgttgacttttactgaggctaatcctcagtagaatacaattgaaggaaatttctataagaaaatcatggattggtgcagtggctcacgcctgtaatctcagcacttcgggaggccgaggtgggcagatcacttgaggtcaggaattcaagaccagcctggccaacatagtgaaacctcacctgtactgaaaaaaattagccaggtgtggtggtgcacacctgtaatcccagctactagagaggctgaggtaggagaatcgcttgaacccaggaggtggaggttgcagtgaaccgagatcatggcactgcacttcagcctgggtgacacagcgagactccatctcaaaaaaaaaaaaaaaattatggattgtatagaatttcagcatcagaagatacattaaaactgacagtttcccctgctcattcgaatgtgagtcacctttatggagtcaccaaattctgttcagtgcttaataactccagtaatggggctgagtgcagtggatcacacctataatcctagcactttgtgggggggccaagacaaaagaattgattgagcccaggagttagaggttacagtgaactgtgatggtgctaccactgtacttcagcctgggtaacagagtaagaccctttctctctaaataaataaataaataaataaaataattccagtaatatgaagtcacaattttcagaggcaaactcatttcatcactgtatcgttttcatcgttagaacacatatgcagctgaattccatctttttgtagctaccacccattggccataggtgtcttcccttatgctacacagaagatgccaaactcttcttgcttgctgaaatccgtaaatgggatctcaaaagtcaactgcttatcgcactactttgcatatagcattgtttcggggactctgaaattctggtctcttgcacctaaacccataccagttcgtctatagacccctgacattgagaggcttggaaagaaatgtgatacgatgactgcatctacccagggcaaggtagattatacctatgctgaggccagtgctcaagcctacattggagcagtggatgtgtgtgtgtgaccaccctacttgggaagctgttctccaagtctcattagtctagatagcatcccagccttgccatttccaggggacaattaccaatgtgtgtgccttcccccctttttagcagtgtgattttgttgattaagtcccctttgtttagaaaactgggataattcaggcggagtttcacctaaaattgtcacagtggtcgctaaccaaaatctcttggggaaagttttacaaatgtacaaacctggatcctatatcctgagactgattcagttggttttgggaaggactgagaggaaaatattttgacaaggcttcccagttcattgtgatttgcaaccctgcttacatgctttcttcactcattgctttcttcactgggaacacataataatgtaccattgtggaagtgcttcacaaacctaatcgtcagactctcctgggaacttttaaaatgcaaattctttggtgcacctgatacctgtggtctggtgtaggtctaggaaaattcatacactaagagatcaaattactatatgtttcccttaaggattttggaagcactcatttactctaaaattgtggttcacgtataagttacaaagcacccttatcatatactgaagaaacaagtgtcactaaagaataatacaatgtaaagattttagcctagtaaacatctacattttatcaattattcatttaacaaatatttctactctgaagcagtgttgtgataggtgctggaatatgacagaatatgggggagaaaaagaaataacagcaaacaaaaaaatgagcaagtaagtcaacagataaaataattacaaaccttaaaataacttaagaggaagaattcatctaattttgaatattctctaattcagaccggcagtacccagttatgctcaaattgtgactttctgtcctgctttcattacatttcttgttgtactctagttcagaatctgcaacttgggagcctggcattacaatgcctttggcagacatccctaatcaatcctagtattttttttccctacagatccaggagggagacccatactacagctcaaccctattgtttatagagtcatgattaacagatcacagataaaatgctagatgaaatcatgcagcttctctagcacacactgccctgacatgcctcggggcttttgctcgcactagccctcatttcctgctttgtcattgttgtttatcaatcattgagtactttcagtgtttttacatctggaatcccacttaatttttaaaatggaggtgtctaaactgtgccttagaaggctcaagtaacatcccaagatcacacagtgtgtatcaaagcaagactacaaaactcaggtcactggactccaaagctgatggtcttaaaattgttcatcattgcctctctttacagcccagttcaaggggcaccttctctgtgaagcttctcctgaccccttcaagcaaaatttaccacttcttcctttgagtttgccagggcctttgtacatccccattacagcatgacattatactttaatgacttgaatgtagcactctttgagctcctctgtggtaggagccctttttttaaatctctgtatccctggtaactagctgagtgcctaggcaggctcttagtgacacattttggatgcacattaaaatctggctgctggactcattaagattgtgggtctgtttcttagtgcttggccttaacacactaaaaataaggccagatttatacatgatctttaaaaaaataaaaacaccacatgcaatacatatttttgtaatttcaaagccttcctaacatcagttattgaggactcttaagcagaaacctagtcacagggcatttagcctgtaaggacccctgatctctagttcataaacaccctccagtataacgggggtaaaacagatcaaattacctacaccctacttgtgaagtgtcacaccacagatgacaactgtttaaactgtagctcttgtcctataaatgaaactgtggttgggctctctgctgtggcctgagttctgtctgggttgatggtggcacacagtgacgtttccattttgcagaaactcaggaaaactattgagttgcctgacacttatttcacagtatgttatagttttatgcaaatatgactcattatattcaaaagaaaagttatggaatctgtgctatcatatgtgacacgtgagaggctgatcgcccagataggtgtaagtaaagatgtattatatatataaggtgaggatttggggttgaaataatgctctagaaatatcactggacatgagtctcaagagagctgcaacattgtctcagaaggaaagagctagtttcattgtagccttccctggaaaatactagaagcttgttattgacttcgatgtcaatttgcaaaagacagatggagaaagaaggcatgggccttctcatttcatagattagagcgaatccctttgttatgttatcccatcttggacacaaacaggcacccaatcttataagttgacatttaaccttagtactttgacagactaacatacctccccagagaaggcctgtccattgaggaggtgctccgacccttggctgtcctcactcccaaagtgtagtcggatctcctccagccggtggctgtatgtcatgggccctccagatatgttgaccaagtgctccttgtccaggcgaagggatacgtgtcttccagtgttgtacatggtcccactgacctgcaaggcaattagcaacaggtcaagcaaggccctccttcttctatgcctccccaaacccagcatggtgcttggatcaacaccttttgcttcctcttgatgggaagatgggctaaatccacatgtggagtagggcgtggcagctgccccagagggtatatgtgggatctatggtaatttctgtgaggcataaaccacatgatggcttaggaatttgaggtaagaacttgaaggagacttttcatcatttgtgattaatattttgtgcattgtattttataaaaaatgaatttgtccttcttactataaggatttggaatggaaagatactgcaagagttctaaatctcagctgtgagaaattggagaaagcagttagcaaggggtgagatattaagaaggccaaatgagacagggaagagaaaatgagtgactagaagcagacgctcatgggagatggaaagcctaggtctgaattctcaagcgtcctatctggtgtgtcctgccctgcaaccagacattgcacagaatcctcatagcttgtgggcctcaagtggtaaactaaagggattcactcaaacttccaatttcatagattcctagacttactccttattcctgattccatcttgctccagccccttcaaactgctaacatgactgcttggcattccttttccttcttttcttgctgggacttgatgttcagcttcattttcctgactgtgacctcaacaacaattgattctagaacactcattcccatctgaaactctactttcttactctcttgggttgacttagctctgggagtaggatctagagcttagggagactttgaatgagtctggaaggagtgtttctgggttacaggaggctgaactatttggattttcttcctgcttactctgactttgggccaagccttcagccctagtgattcctgaagggcttcctgtaccttctgacaccttcattagatgtggttttcatatatgtgctctatagcactatcttttacctgcctcttttccacctttctgacactggtgttgtgaatgattagctcttgagttgttcactgtggcagagaccataatgctcaccaaatattccagtgactcattttgtttcctgccaccttactgtagaatggagcccatgtgactgataggggccatgggttgggaggggtcatgacaagtgtcacttccaggttgaaatagtggattccccagactcacctttccctggtacatcgaccaatggcattatatggaaatggcaatgtggtgcagcgactgcatggagctcatgtcagcctaggcccctagagattatgtgcagtttacaaaaatgacaggaattcttcccctccctataactacactcccaacaatgtaattttgtaactgctgtcatctagataagaggctatttctctacgtcgagtctgggctggccttgtcacttactttggccaacagcatgtgctgcacacaacatgctagtcctgagagtagaccttgagggcatgcgtgttttcttcacttcttcgtggagccgtgaaactaccatgcaaatgagcctgggctagcctgctggaggatggggccacagtgaggagagccatcccaggagaggccgtctagacgggctactctgtggctgatccactagctgactggcccagctgagatcagcttagcctggcccaggtcagaaatgtccactgacccataggcttggagctaaatgattatttaagtctctaaattttggggtggtttgttatgcagcaaaagggaactgatagacactaagtcagtcatcttctttctcctgtgaaatctggaactatcaacagaaactctccgttgagttcctgaactgcaaggtcgcctgagtgccaaccatactgttaagcagagaaagtcagatcagagagagaggactgaggcagatgtcccaacattgacagaggagaccacacactggggaacgggggagggaatggggagaataactacttcgcttcagatatctttgtgtctcttcgttctagttccttcaagaggcctgaactgtactttctaatattctacaccttaccaatacatttttaaacctcaagttatctattccttgcaaccaaatgatccatgccaatgacttcactcctgttctccagcctcaaataaatgtatatttagttagtgtgagataatcagaacttttcatttcccataacttccttttcagtacaatagctcaagacagatttgtgttagacgtgacttccatctctaaatataacctattttttctaattattaagataatacataggcattattatatggttcgaaagatatgggacagcaaatcgaccacaatttcacaattaaacaggaatcaccactaatattttggcatatatataattttcacactcatacttatagacccataatttaatgagattttatatatgtgcattataaatatataatatagacttttcacttgcatatatgtatattatatatgactttttatgttattctaacatatagatatttccatgtcattaactattctttagcaatatcactttgaaatatctacatcatatttccttgtaaaaatgtttagctgattgttgaatctttacagccctttcactttttcattattgtaaaaaaaatctgtaataaacatcctcatggataaatcttttcacgaatccagagatatttcattatgcaaattccaggtcaaatagtgtacacattattacagcatttactatgtattgctgcatccatctgctatggggagtagatcccacagagcagggctggatctctgtaattcccttcaaatgacattaagcacagaaccatgggattcaatctagtgacattctgtggtataaaaggcaacaaaaaacattgctccaagttcctatgacatgcatgctttgtgccattgggcaagtatcttgggcttcctaacacttctagaaatcctttcatctatgtctgtctaatgttctcaagaaaattattgcccattgaatcaaggcactgactacattttatgcttgtgtgaattttcccagtacttgggaaacacactggcacaagtaggtggaaaaatcaggggccctggagtcaaaagattctcagtctgcctcttgcgacctagggtagtttactgaatttcttgaagcttcagttttcttaaccatagaggtaacagaatttcctccatgaaaatggcagacaaaaaagctataaggcatattgaaacaaatagcaaaatgacaaagtcccttcttatcagtaattactttaaatgtaaatggattccacttgtatgctatatctaaagtagccaaaatcatagaaacagaaagtagaatcgtgattgccagggactgagggagggaggaagagagagttagtatttaatgagtataaagtttcagttttgcaaaataaaaagagttctggaaacagatggtggtgatggttgtacaacaatatgaatgtacttaacaccattgaattgtacacttaaaatggttaagatggtaaattgtatgtcatatgtattttacaacaataaaaagttggtaaaaattgccctcacgaggttgtgataattaactaatatatgtgatggtcacacgtgttcattctcttccttcccttactcttggctattatggcatgggtgcctaggtgatattgaaggattctcgttgatctttcttccccatgtcttccccaattcccagagcctggtggaatataatgttgcttgctaaatgtcataatgaagaactggagctaacttctgccttgtgatgattcactggcctctcattttggattttaaggtgctagacatgaggagaatgcaagatcatattgaaggccatgaagcaaaccccaaaccagaagcaggaatacaccaatgtgccttctagttcttcgatctcacttccagaccccttctgcatacatggctctgtcttcattcattcattcgcttggccatttactcagaacaaaacattcaatgcacctaacagtgtgctaggagctggggacagtatgactttgaacaaagccagtccctctccctgccatcatggagctcacactccattatggagagacctgaatgggggcacaaagttatgggcaatccataactgctatcattttcctatgtgttcttacaacgagatgcaacacccccttttccccactcttcccatagataccgaaataacattaatttgtattaatcaaaaaaagctgtgtagccagggcatggtttgttgcactttaatttaaaaataaaggcttgacaacgttatgtatgatatctgagggtacatctgcaccgcagtaattaacattgcagcagtgccattttatctcgaatgctaattactgtgttttcaatgaactatttgggtgcgcagcatgttggaaaaagttatattatacagaccaggaaacaaaacagaatggagaagttgaagctgcaggggatatccaggttgcctctggctgcctcacagttctttttgttttaccttaattcactgcaaaataaggtgtgagatgggtgtgatgtccattttaccagcaaaggaagtaagcgggggctggtgaaggttcagtaacttatccagaatcacacagtggcaggtggcaaacccaggtcttctgattccaagactaatgatctcgatgtaagcaaatgcaagtgtccttgctcatttcagattaaaaaaaaatactttggggggccaggtactttggctcatgcctgtaatcctaacattttgggaggtcgaggcaggcggatcacctgaggtcaggggcttgagaccagcctggccaacatggcgaaaccccgtctctactaaaaatacaattagcggggtgtggtagcaggcacctgcagctactcggaaggctgaggcaggagaatcacttgaacccaggaggcagaggttgcagtggctgagatcgcgccactgcactgcagcctgggtgacagagtgagactgcatctcaaaaataaataaataaataaataaaataaaaaacaagtaaataaaaaatatgttggggattttcatttcttctccagtctctatttgcagatcttaggcagttccagaaaaagtgggatctttttcaggaaaagagaggactataattggatgctagcctgctgaagttcatcccaggaggaggcttcgagaaacctgaaggtcaaggaagtccctcaatttcctcacctgcggaattcatactggtttgagactggttggagctacgtatattgagggaagcaggtaataggtgctccacagatgtgcctgtccaggttgtatgtcaatcaatattatcttgataacttgagaccatctagaagcactatgttcttttgcaaagcaaaaattgtatgcctggtgtatttattttgcaaaattagatgtctttgcatagcaaacacagtgctttgcagcagtcagtgatttggggcctctaataaatggggtcatcttttttcattctggtgacactatcatgtttagagggaaataaatttggtcaatgcatttttaaggtaggaaaaattttcattctttgaaattcagccacaatcctgttcataaagatggcatcttggttagaactttactgggtgccacagggggtggcggtaaattctgaacctgaattttctctgttaatcatcacaatttctccctcaccaaacccagcaccatttgcttattctcagtgggaagatattaggctaaacccatatgtggagggaaggcctcccacagggcatacctgtcttacctggtttctatggcactttccatagaagcaaactgccatcagtcgggggccagaacttgacctcagctatctttggctctaaagcctgtgcttttaaccactggaaattattaggttgtgcagtttttgtttctgttttttgatacggagtctcactctgtcgcccaggctggagtgcagtggcgtgatcttggctcactgcaacctccacctcccgggttcaagtgattctccctccacagcctcccaagtagctgggattacaggtacctgccatcacgcccagctaatttttatatttttagtagagacggggtttcaccatgttggccaggctggtctcgaactcctgacctcaggtgatccacctgcctcggcctcccaaagtgctgggattacaggcatgagtcaccactcccagccacagctggttatttaacaatgtaatattacagcattttcttcaagaggtgggttgagagtgtaggagcctcacagtagtttggagctcaggatgtttaggattacttactgtttactcagggttctctagagaaacagaatagtgtgtgtgtgtgtgtgtgtgtgtgtgtgtgtgtgtacatatatatgtataaagacgggtaaaataaagagacaacacatgcgcacacacacatacatactactgtgtgtgtgtgatatatatatatatatatatatatatatatatatatatatatatatatcacgtaaaataaagagattttaagaaattgtctcatctaattatggacattggcaagtccaaaagcctgcaggctggaggcaagagctgatgctgtagtttacctctgaaggtaccctgcagaattccttttcattcagggaggtcagtctttttgatctcttgaggccttccactgattggatgaggcccatcaaccttatgcagggcaatctgctttactcaaattccactgatttaaatgtttatctcatccatagacattctcacagaaatatcccaattaatgtttgaccaaatatttgagtgccatggcccagccaagttaacacatcaattaaccactacacttattttcaaattctatttgccttctttattacatcagttcaaatagctcttaaccaaatagttgttctgataccacacataaagggttatatatataatacaaatatgcgtgtgtgtatatatacatgcatatattatatagctacattatctatatctgtatatattatatatacacatatgtatattatatatgatacaaacacatatgcattttatctatatatttcctacatcacataattttaaaagtcagctacacaaagactgttttccaaatgtcagtcacatagaaggagaaccagtttgaaaagatgtacatctgaatgatagaacaattataaagaaataatttaacttttcttgttaaagaacaaggcaggtttatccttgagtatagatgggaccatggagattattttgatgtaaatcccctattgttttgggtcttagatgttgtataaactcatattttgagataacaaagaggaagaggtatatctttttataaagaccaattcacaaaatacacatgtcaaaggtcttttggtttaatggagatagcgcttgtagggtggatgtttactgcagaaagctaagctagaggaaatcttaccttcagaaattccaaaagattcaataagtagctacttgcttgatgtgacacaaagattatgtgaggtttccgatatgttctctctcaaggcagtctgactcagatctcctctaatatagtaaaaaataattctctacagcttaaatggaaatataacactaaaaatggagtagctgagaggaaatagaatttcagtcatgcagaaggaagagatggcctatctgacgtgtacaggagctacttgcattcttaacccagttagttaggaaaggaagggtggaggacacctactaattggaggatttactatgtgtcagatgttgtaccactttttagattagaaaaccaggtacaggtcggctaagaattctactcaaagatacaaaaggaataagtgaggggactagaattcaagtcttcatgacccaagctcatgctcttcccagggtctcaaggagtagcttcaaagtcactgtagagagggtgcactcccatttctcagtgaccatgtacatttcagaaatttcataatgtcctttttatttatttactattctatatggaattggcacctgggccctgttcactggtaacatagaagagccggcattcttgcctttgagatttgggatacagtcttcttcagcagattttttttttttttaaccaacaagaatgagcttgaatcaacagattttcttttactataactataaaaatacataactataaacacgctgggagctgatagaccacaacatccacaacagcggcttgactgtggtgtactctgggctgtgtactcagtccctttccatcatcatctcatttcacccttatgctgcccaggtgaggaaggcattatccatattctgcatatgaggagacagaagctcaaaggggttaaaggatttttacttaaagcaccacagttagaaattggcagtcccagaattctagcccaggcctatttgactgcacattctatagctctttaaaagagaagaagtcagaagttggtaggaagagtgctgagtgctggggaaatgaggtagttgtttttttttttttttttgagtctttgctctgtcgcccaggatggagtgcagtggcgccatctcggctcactgctgcaagctccgcctcccgggttcacgccattctcctgcttcagcctccggagtagctgggactacaggcgcccgccaccatgcctggctaactttttttttttgtattttttagtagagacggggtttcaccgtgttagccaggatggtcttgatttcctgacctcatgatccgcccgtcttggcctcccaaagtgttgggattacaggtgtgagccactgtgcccagccatgagatgaggtagtttttaaaaagcttctggggttagggatcaattcttaattaaaatatgatgtctgcatggatatgccaggttgggtttaatgtatccagacctggtctagacccagggtggcagggcagttccagtccccgcttgctgggagttgagagatgggtcatacctgcctctcctagtgttggctgagcaactgggtggctgagcccaaaatgttgggaggccactcagtgaagaagattcaacggccgtgtcatgaattaggtgacctttctttgcaaccgaagtttcctgttatatgtctctggccactctgctgaggtgtgtaataggctttctttgcaatgtaattagtgagtctgagatttaagaacaccacttagtctagttttctgcaaagtagctcaagagatcaaagggctgatttgtaaagagtgaatacaaaaagccagtgtgctgcctgctcacatgggcactctggaagcatcgacgcaagaaaaaaaaattagtaccaaaaactggagtcaaatcattggcttcagtgcagcatagcagacacacagattagcaaacttaggggcgtatggattctaaagctaaaggacttcagagatcatcaagctcttattcaataaaccaggaaactgagacacagagtggttgagtgagttgtccaggattatgcaaacaagtagcaaacccaagattagaaatcaacccactgagtgtttcttgctttatgtagcactcttccccctcctcttattctcttgcttttcctttaaattatcttatgctgagggtacctaagaatactgactcaaagttagaaatgctagagtactataataagtgtgtgtatacacaactaccatagcctatagaaaaacagaaacaattcaagttgacatctggacctgccatttacatgacatgtatctagatactgggctcttctcactgtttgtccagatgttttatgctatgtagctttcatagtattgattagaaatggaaaagattagaggctagataagagcatggtggcagagggtgtggagctttaggagtaggccttttttttttcttttgcaatgcatctttgaaagaaagcagaagggaaatatttggagctcgtaggctggggctgttaggaaaagagtggcttagatgtaggtaaataagaaaatggaaccagactggagcgatctgcttcgagttaccattggtgggattgggtaggagagttgatgtacttctgagatctcacccactactcttaaccctgcagggaaaatagtgggtttttttcccttagtaatgctaagtttacgctgatctttctcttacctatccatctgagtcagcctgtgtttcctctgtaaaaaggataggattttggcatctacactgaaaaactagatgaaatgatcacatgcactgcttattatattaaatcatattattattaaaagcattgaatctgtttttgataatattgactcttcaaataatacatgatttatttgcacactctgcagggatgctaggtagcaccattgcagtgaagcatctcttcaacttgattgatcttggtaatgacaaaagacacagagaacaggtgtgaaagatattgcttggttcactaaggcgtgggctaaatcaagagaatgctccctttcctccatccaacccaaggataccatgggctcatggctggcattaggctgaacatgttcttgccacacgtagtcattggcgctgaagcccttcacctatttcaggctgcccagcctctgaccaggaaggcacacttcagagagtggtatctggaatgagtttttccctcacaatcctggtatgtaggtttccggggggtgagtcccatgtatttctttcctactgaaccaccactgccaaccaatggttttattagtttaatattgttattttaataatttagtattataaacaaaatttaaatttgttaatttgtcttctgtgtctgcttagctgccttatgaacattaaaaatcctgacacaaaaccttcgaggtcagcatgagcttcccattttccagtaagagggtggtgccacatgctcagctcatatggccagtgggttcaagagccagactgtgaatgcaagactgtccgatttcaaagtcaatctccttatgcttcactgtgcttctcttaagtgtcaacaagcaggcctaatccgtatgaccccagttcagtgtgggtttctggtttagttctccaattcctttacctgggttaaaattcggctttaaaccttagcccactagcatgtggagagcctggagagttcttgtcaagcccctcattgttggttgtctggatcaatttttttttcttacttcttagtgagtggctggagtcttatgccaactggataaagttattggaaccaagatggtaccagctgattgattagcagtatgcccccaatggaattgcctgtgctgctgctcctttcatgagttgggggctcaccttggctatctatgccagccgaaatcaagattgggttgagtacacttctttgctctgtgtgtgtgtgtgtgtgtgtgtgtgtgtgtgcttaaaatatattttaatatatcaaatatatttaatatatgtaaatatgtaatatataaaatatttaatattttattatatataataatctatatttaatatatttattttttttggtaaggataatataggcatgattggatgtctatttaccagtcttgattcctgccatatctcagcacctgaacaatgtttggtttccatttgttggatgaaaatggataaggttttgctttgagcatcatctgggtacctggtccaagctccaccccccattctgcctcagtaggtctgaggtgggactcaggaatctgatgtcttcctctcctgagcttcctttgatgttcatttgagctgagtctgacagttcttcagtgcagtggggaaggggtacagtaatatagagtgactttttttttatcctttctccatcctcccttcgtgccttaaggaattgctttgataattataaagatatagcactaaagctctttctaaatatatgtagtgggttatacattgattcatcttcaggccactgtttttccctaaactacgaaaattcaaggttaggctgctttaattaacatactaaaacttgccttagaaagcttatttctagtttaatgtcatttaattcaatccctgattcacagggcttcaggcaaataactcccgatctccagttattttatctccaaagaggaaaatgccttttaaggggtgcctgtggaacacagtggcacacaggacactggcagggtccatagatccttcttaacattccccgtgtggtcatcactggtcagatgtcagaatccttgatgccagtttttcaaagtagaaatagcaaatgtttgggggataattagatagtaagtctttgctcattcgtcatttcattgtatgcaagttaagtatgtaacatttatttcccatggtgtccttgcccctataggctctctctcactatgactgctgtgctctaggacacactgaagacagccacagtggtcagcagacagggtaaatcagtgagacaggccaggtgtgtgacagcagggagcggtggagatggtggcggtatggaggagcatcatctctcatctcttggatgtctttggggcagtattcaggacactgggagatggcctctggaggaggaacagagagaaatgcaggaaaaggaggggatgggatgcgagacttacttttcattttgtgctctttcatattgtttgaattttaaaaataaacagaatcatttttaaaatgaaatgaaagactctgtagacaatcacatctgatggtataacctgggatgtgtgctacaagagtcctgtccaatacagcagctatccaaaagaaacagaaggcaagctacatctgtaatttttaaattttctagtagccacattaatgaaacaaaacagtgagattaacattaggagtttatttcatgtaacccaatatatccaaaatattatttcaacatgtaatcgatataataattatgaatgaggtgttttatattcatttttcataaatcttggaaatttaatatgtattttatactcaaaacacattacaattcgaactcaccacatttcaatcgcggcatgtggctagtggctgccatactggaagtgcagcctggtcgggtcagtcttccttcccaagctgccctcccttatgcgaacacagctatattaaggagtggccggctgggcagctgctgaggataccaggctctgaggaggcttaaacactccatgaataaattaggcatctaatgccagtaacttatatttgtttcctacccccaaaacagacagatagccctctatctgttgaggtttttttctttttgagtgtgtgattcatattgcaagttttatgggccaaccaccctgggagcagccaagtgacagttgcctgggttggcagttagaatctattgatgttgaaactcagtagtgcatagcttagtgctatttactaggaatacataatgtgtcccattatctaaattataaacctcttaatatctctcctaagaatttggttgaatctgaaaatcatttaaaaaaactgaaaagataaatgacataaaagtgggaaaccttttgttcacaggtatatttgttgggagatgatggaagaattcccaggggctttcatttcactgcttcttcctcctcccaagattacctaatccttgctcccatcttgaaggtcaatcatttattctattcatcaaagctcctagttttgtcagttaatgactatgcatttggtatttcacattgctgtccagttttcaagtatttgcatttctcagtggctctgcaagtgtaatgaacatttgctgtgccgtggaagcaaggcgtagggtcctaaactgatatatagacatcatccacaaccaaaatccaaacaggtctctacccttcaggcacttattattggatttaccactgatgctatttacaactgaagcccttaacaagtgaggtgtgaccatagaaaaagacaccagtttctagaaactgcatgcatcctttctagaagcaagcaaccaaggagactgcattttctaactagagatcatatctagatatactaataataataatccatcaatatcactaccatctacagagctctatatggctgcaactatgcatgcattagcaacttgatccttgccactacctcatgaagtggatatttttattatcaccatttgatgaagaaactgaggctcagtgagggtaaataggccacagatctgtaagtgtaatagataatacatgtgaaagagcccatgcctggtgagctgctgtattggctgtaaggaggagagatgatttttgtccatgggtactggggcatttcctggaggagtaggcatttgaaatgggtgttggagcatgggttattggctctaaggaggagagatgatttgtgtccaggggtacaacaggcatttcccagaggagtgggcatttgaaatgtgtctttgagcacgggtaggatgtaggcatctggagatgcctagaatagggaataaaatcagtgaagacttgggaatgggcaaatataaggcacacaaagggagtggcaattgtcatgagtccagtgttcccagagtgattggaacaggagcagctgcggggaggggtttgcacagaagatcggtgacagtaggtgccaaacacccactgtgtgacagattctttgctagggcttcacatagttctattatttactttccaccaaaatctgtatggtaggaagtattactatctctgagtcacaaataaggaacaccagactctgaggggttaaataacttgctcaggtcatacactagcaagaaaaggagggagaatttgaatgcacatctgtccaaccctttccactgcaaaatgaaacaaatcatgttttaaaaagacacttttccgaggaaataatgtcctgcttttatgctctgccctgtgacaccaattctccagagttgctacatttctatatcgaggcaagcccccactcttggtgcctcctctgtgatgtgcatccccacctccactcccaccgcacctctttcaatggtcttctccctcttgcctggtctttgcctaataggaataaaacataaaaatcaaaacccaagaaaagcccaatgtcatgattatcaagtagctcacagcaccagctaggattttaccttaggggtgagaagatttatattgcaataatcaatatctcagaaatatgtggctcactttctgcaactgacattccatttcatggcttcaaagcaatggttacatcagccagtttgcgtctttaatatagtgaaatgcctactgagggaagtcggtggagcatgtgctgtgggggtggggagtctttattgccatctaatgaccctaaaatcagctctctggttatccagcacgggaaagcaaatggaaccttccatctcatccatgacaaaagtattgagtggttctgaagttatttgtacaattgatccagctaatatcaggaaagcatgttcaccagatgaattagagacaattaaatgcaattctgtgctcctgttttctatacacagaagacaatcataaacccagagggtccaaatgaaatcatctgacccattttaacaccctttccgtcccacattcaccattctagtccactgaaaagcctctcagatttccactcgatgaggtgatttcatggtgcatttctgctatgcaatccccctacctcttttactgtcaatgaacttaaatgctcacagcaaaacttattttcatgagttcctttcagttgcttatatacacacacacacttagcagagtaacctttccttcttctccttcttcacctctgacatacactcattcaacaatttaaagaaattccacctcctaaaaaccctctgtaatctgcccattctctctgtctctgctaatgtatcttattctatccctcatcttattctgacccctcctctctgtcccccagacatggcccaacttaagcccttattttaccatatttcctgaaatatgccataggttgtgaaatatatcctgattttatgaaccaccatgaaagtaaaaaaaaaaaaactctacaaataaaataaaataaaataaaatatgccattgtttgtaggaggcctcctaaagagatgttgaaacatgaaaaaaatgtgcatcttaaatggatgatacacagtatctctatgaaactcttatcattgtctcctgactgctcatgccaacaatcttgtagtggcacaacaggcccttcacaatcaggctctgagctgcatctccttttcctaggcttgcaaagccccttctcatttgtcaagaccacctcctcaaagtcctttgaaaccccacaggcttggtgatgatgcttccctgagttcctatgacttccttaacttaagcgtaataacacataaacatagctttgtaattatctgcccccatgtcccactatgagaaatccttggagaaaaggctatgtgtctccttcacctccatatccccagtccctgacacaggacagggcaggtcctccttgaattgctgaatgcaatggactgtgtgatacatgtagcttctgaacctagtcactagagggcagtgtggaaccatcccattgcccacaactgcggttccccaagaatctaggttgcagaggttgtaggaagctggcctatggctgagagcctaggaggctacatgactccaagggcccagtaccattctgcagaatcgaccctgaggatgctcctagcatctccgtatttcttgccagcctgcccactaggtgctttcaagtggctgcctcagcacatttcttgattaagaaccaaatgctcttcctagctctccacctatagggatgggggcagaggccacagagagggaaataaacgtctccttaacatccccattctcatttctaataaaggcaggcttactgtgaagggcctgcaatataactgctccactttgaagaacaacaggtagcagcatcaatatttgatttttaaaaggttgtgtgaacagttttaaatattaaagataaaggcaaagacttagatcatctttttatctcagcagttgaagattttaaatgaaaaatggtgctaatgagcagaataagactgttcacccatcaaatggtatctggttgcaataaagcaaaatcattttggggttggggggagaaggggtgggaagcaatatctgtaccagagaagttttctgttcattatctctgtaatgagagaaaaataaagccactctgctggagtaactttcttctatctcatcgtgggctgtttagctccctcaatgagtggtctgggacaggctccgagaaacctcataaattaactatccaacttcctggctaatgagcccaatatgtcaatttctagtgatcaaaatgatgcaattcaatacagcacagttcattttgtaaggaaatatactcttaatagagagaactgcagggtcaccgtcttcccaagataattatgggccagagaattagaggcgtggagctgtacttactgtctggagatatcccatggggtttgtgtggcagatattgtctttcagggacaataaattccttcattatatttccattactgcattaatgcagcgatctccattttagttgtaaccaagaaggctggttattcctgaaacttggcatttaatgctaatgagagcttgcaaggcaggcagctccctgtgtgtgtgtgtgtgtgtgtgtgtgtgtgtgtatgtgtgtgtgcatgcatgtgtttagggggggttgggtatagacaatccagcagaaatgtcaagaactagaaggtaccagggagagtctggagggctgagatggctctgaccagacagacagatggatatctggaagagtcaggggtaagtagtctgagagccaagagtaaattacagctgaagagagaagctgagatcactacgaggtaagcagtgccaagtgtgaaatccagcctgagaaagcaggtggtcctgaaggtgaaacaaacagatgcaattcaaaaacaggaatgccgggcagcaaaagggttcaggaatgctcggaagtaagcaatggtgctgtaaactcatcctaattcagggttgcctacgaggtatgagaaaaaaccaggcacttggtggtggagccaaaggcagccctagccaatgatatctctttaaaaggctccagctcaaggtagaccctctaagagcaaggactccatgttcaggcttgctggaattgcttgattctataatctgcaccccaaaataaggtacttatttggttttaaagttagaagtggatgaaaatgaattccacaagtctccatgtgagagctgatgaagctccagcatgctatctaaccatgctggaaggctctgatctggcagggagaaccaggtgggaaatactggtttcactagcatttttcaacttgattccagtggagtggacaggcaacatagtaggagaaaggacagctcctggggtcaggttcaagttctggctcctttgctcttagcttcatggtgttgggcaggttgcttaacttctctgagctgtggtttccttagctgacatttaatttgctgggcaatctatctatttgcagggaagtggggagataaatgaatatgtcagtttgcttatttttgcttatttttatttctccaacaccaaagataagaaaaaataagttataaacagaatcaggattctttcccttgaagcaattcttatctaaaatggactttagtcaggaaagtaaggttgctgttaactcaagtaacttgggaaaataattgtgaaaagaaaaattttccatgaatcagagagctcaaaattataatatgttaattaggaagtgtttacttaaggtgagaagtggattgtgctaagttcaacatcctgccagaggtcctcgataggcaatgactggcaatgcccgttagcttgctccatccttgcaataaaactcattgtccagaagtcttgggaggtgccttggtagagatcagttgctatttaaaaaatctctaactgttgacttttaccttgtcttggccattgactaaatccaactattgtgcactgagtgtttactaactgcaagttcattttaaatgttctctcatttgatctttataataattgcatgaggaggatttaattatgcctgtatttagagatgagaaaactgaggctcagggagtttagcttaatcacatggttagctactaatagaagaagaggggagtttcacactcatacttcattcatcattaggtggatttcatatctcacattatttttagtactcatcctcagtgactctggctttgagcctcttaaatttgtaaaacaaacttgatattttggaataatttcagtaggtctgcagaaaagttgcaaagatagtacacagatttccatatatccctcacccagcttcccctaatgttgacatcttatgtaatcattgtacatttgttacaactaataaggtaatattgtttcaccactatcaactaaaccagtgatcccccacctttttggcatcagggactggttttgtggaagactatttttctagggatctaggggtggggggacagctttgggatgatcgaagcacattacatttattgtgcactttatttctattattattacattgtaacatataatgaaacaattacacaactcatcataatgtaaaagcagtgggagccccgagctttttttttttgcaactagatggtcccatctgggggtgatgggagacagtgacagatcatcagtcattagattctcataaggtggacacaactcaaatctctcacatgcttagttaataatagggttcatgctcttaagagaatctaatgctgccactgatctgacaggaggtagagctcaggcagtaatgtgagcattggggagtggtccatggcctgggggttggggagcgctgaactaaactacagactttatttggatcttaccagttttttcacttatgtctggtttctattccagaatccaagccgggatactacattgcatttagtgactctcagttttaacctgattatttgccacaatttccttcgggaaaagttcggggtagggataaaggctaacattttttgtagcctggatccacataaagatgtgctttttttttttttttcttgtttatcttttattttgcttctggtagcagcagttcttaaaactcatggcacacgacactttcattttggcctgggatcttggcctgcttgtacaatagctgcaaaggtttgggattgagattcagctttcaaaagcgactctccatcactgtcttctttcaaggacaggaaatttcaaatcaactttgggctttaccattcagtgtgccaaacattcctgaagtttctacgattgccaataaataagacattccatcatctttaagacatcaaatcttctgataaattgaatttcataaaatattgctctattgatcttagtgctcaactttcaataaggcaagccagcaagagttgctggctggtactttttctgcaatgaggatgtcatctgcttacatggggagagacatttatgaggccagggttcctgactttaaatttcagttcctggcactatatcaagtccacagtgatgacagttaccttctctccattgctgctgctttaactttatagaaaactttgcttatgcttattaaacaatgtggcacaaaccctgtgaggctacactgcaagtcatgtaagctagtacttggcacatagtgggtatgtgatctctgttaaagctctctttccagctaggacaaaggaaaatcaaacttgtctcaaaactcaattttgagagttcatctcgttttcagaaaggaaagggccaatgatgaaaactgatgacatggcaagactgagaagaaaaaaacacagtatttcttctccacacggtttttccagggctgctcttgaaattgtctgcaatgatgtgcatgtattttttttaattttaaaaacaaataacatttttatacttttataatgacaacatgtcttgaatgccatctgttcttgccatttgttaaggcaactcaatgagaaaacagcattcggatgactaatatttagcctgctcatagtttttaaaatggatggacagattcccttgagattacaccccaggatccatggcaagctggtggggtgggagagctgaaggtggagtttttgccactactgggcacactgggtcactcacccagcatttcttaagcaatcacaaggtgccaggcagtgtgctagaactagaaatataatacaaagataaaagagagactcatctctcttgtggggactgaggagtaaatacacaattctgtacaaaatggtaagtgctaagacagaggtttgcaaagggacgtagtgaaatatgtagaggaagttaatgactcacaccgtgtgtgtgtatttgggggtgatggggagtgggttaaagggtactcagaaacatttctgggaaggaaataaaaccctgacatcagtctagcagaattggtagacatcagctatatgtaaaagggggtggattcaggctcacataaatcctatgagaccagcacagtgcatcaaagatatatttccagtcatccttctgtttgaactagaccagagaaaaagtgtattcaatatagctagtgagttaaacactacttcctgggcactcaccagtgcatcctaaaacggttgatcaacatgaattgattgttcagccccagaccaggtaaagaggggatataagagaagccaacgtggttgatgatgggagggcagccgcaattcagccacaggcaatgatcaaatagcaatgtggggcagtgtgtaaatatgggggtccatttatgctcaagaaatgggtgcatcctctgttactctgaggccataaagttgctactctgagtcttttttaggccagttgctggaggatctggtgtagaaaggctagacaggaaggagatctaggaggcttcctcccaaatctaagattctatatctctgttgctcttttataggactgaggttaaaccttttaaaaatagcctctgtagttttttttttttccctagagctatttgggtgtgcctgtctgtttttaattcataagaatgcacagtagctgcacattgtaaaatgcattcctgacaccctccccgccccgcccagaaataaaaagctttccaggcatgacttctacgttattctctaaatcatagttatctgtggtgaccagcaagttaccaaatatggctataatatcctatgttttctccatatgctatggagaaacaaagaacccctaaacaatgaaaactaaggagacacaaaccctcccccgagaccctaggcttggaggggcacgaaataataccaccattaatactaatatttgctaaactgtattgtgcaaatttgctcaactgtttcctctgtttcctatgtgcaagaccctgtgctgagcacagtatctcactgagtcatcacagtaatcctgtgagctggtactgattgtattaggctgttcttgcattgctatacacaaatacctgaggctgggtaatttataaagaaaagaggtttagttggctcatggttctgcagcttgcagaggaagtgtagcactgtcatcagcttggattctggggaggcctcagggggcctttattcatggtggagggcaaagagggagcaggcatctcacatggccaagtgggagcaagagagagatagtggtgggggaggtgccacacacttttacaaagaccagatctcagccgggcgcagtggctcacgcctgtattcacagcactttgggaggctgaggcaggcagatcacgaggtcaagagatcgagaccatcctggccaacatggtgaaaccccatctctactaaaaatacaaaaattagcctggcgtggtggtgcatgtctgtagtcccagctactcaggaggctgaggcaggagaatcgcttgaacccaggaagcggaggttgcagtgagctgagatcgtaccactgctctccagtctggcgacagagtaagactccgtctcaaaaaaaaaaaaaaaaaaaaaaaaaagaccagatctcctgtgaacccagagtgagagctcactcttcaccaagccattcatgagggatccacccctatgatccaaacacctcccactaggctccatctccaatactggagattatatttcaacgtgagatttggactgggacaaatatccaaactatatcactaatgttacacttgttttatagatgtgaaaaggtgctccttataatggaggatgattgacctgtccaaaatcacagagcaagatggtgataaaatcaggtcaccaagccaggcttgcccagtgctaagacttctccctattatatcacctcccagaattaagacaatggagttttcccatgccacacccagcattgcctactctctgtaatggctatgttgggtctggagactccgattttccatgaaactcagtagtcatacacttggaaatctcaagttctgcctttcccccttttggcatgggtggctgtcccactatgtctcagccttgccacttcttcctaaatctgagaaagtgaatgttagccagccctgactctttcctgttgacttagcaagcactgattgaacttgtacttggaacaatggtttcctaggttctgagtggcagaatggggcaggaggggaggagaccagtgaggcgaggcttgaccaataccaagctggctaacatcaatatggctctttaccattttacagagagtgttcacacactcattctcctatggttcccacacaggaatctctgaagtaggagcaggcatcccatctcacaggtgaggacaaagcctctcacagagtgtatgtgcctcatctgtggccacgtgctctgcagaatcagggttcaattaccatccctgtgatgcctcgtggagtgctctgcattgctgctggaatcctatgtctcctcctacttactttcctctatttcattctcatacatagctgaacctctctgtgcctcactttcctcatctgtatatggggagaacaatagtggctactgttttgttgtgaagattaaataaggtaatacatgtaaagatagttgaaagagtacataacacataataattacttaacaaacattaggtactcatagttactattaacaattactagtattaccattactgctgatactatgatgcacacacaagtaacaattataaagatatatgcaaataaatgcaaatgagtatatgcacttgcttattattttacaatgaaagtgctgaatgatacgaagcaaaaaaaagtgatataaaataagatttcctaaacttggctgtttttgatatatatatatccctaacatttcatgtttcagtaattaaggccatgaagagaactaaaatattgactaaatcctggaggaatttccaaatgggaatgatggaaagacagacacagagacaggccagccaccacagccaccaggttaaaatgagggaaggcctacaattgccatgggaacagagaagacaaggagagggaaaagagagaagcatttttttttttttgaactaggccagctaacacagttatgtaacttaattgtcataactgtcatgtgagatacatggtattagcctcattttacaaatgtggaaattgagactcaagttcaagtaccttgttgaagtcacaaaatgaaatggaattttaacagacttttactctaaaacccatgctttctctacctctctaccaccaacagaagcttctggggagcacctcgggagacagccttttgatgtctcccttctctgggctcttagagcacttagcatctctgtaattcatgcacacaacactcacacacagcatgcattgctttatgtgcacaccagcaagtgatccctaccaccaggccataagctccttcaagacagagtcagcatcttagttgcttttctatttcctacctgactaacatattgacttgtacatggtaagtatctgttgagtaacctagtagagaagagagattctatgatataaaagactgaggagaatgcaaaagctttcataatcaaaggttgctcagtgtgtagaacattctggaagccaggttggagtgatacattcccaaccctggttatagaggactgactcaagtatggatcctttactgcagctgagctgctcagataattgtctttcttatttgggactaggactagggagattacatctggggtagtctcttagagacaggggatgtaaactgaggctttgtgggctagtcatctcctgtctgagaagcagagagaaggatgaagtagacattcagtaggaagacaccctcagagcctggtggagaagttgctagatttctgcaggattatcatcatggaaaggatctcactgggcctttgaagccagattgctcaggtctaaatcttggttctgctccttataatcagtgtgaccacgggaaaactgtttaaccagcccatgcctcagtttacccctctgtgaaataaagatgagaataccttcctcagggtgccatgtcatgtgcttcagcacagtgctggatgcataatacaacttcgatgaactgtagctatcattttaatgttgggcctccatttgattcttttgtgctttccatctgaatgtttcaggcatcttgtatactttttccttcctgctttcagaactctcagaagtccaattgctacttgcaacacaaagcaaatcaagttggctcggttgctggtagacagacctgtctcttcggtggtttctgcctgagcatatttatcagctactagccagaaacacacacctgtattattataagtggcaccccaggtcccagcacatttcaaagcacagactcttctctccttctaaggagaagggcctctgcttctttgttctctttgattctcagggcttcttattaatttggtatagggctggggatattaatgtcctcttgttgtcaagaacattctccaaagtcatgaataatcacgttgtcatgcctgtgtgacttaaaatacaaaaggtgcaatttatgcaagttttaaagttactttttcaaaagagttcaacccatgaagctgtcaggctgtcagaatgtaagcaccaaactagaaccttagcacttacttatgaattttcaaaggactttagcacatttttaattagcttctccccctgcccgcaagcctgcaaaacaatctgtttggctattatattctgtgagtggggtagcaatataatgctagattggtgggaggggtgagtggaaaccttgcttcatttaaggtcttttttttttttgaggtggagtctcgctctgttgcccaaggtggagtgcagcggtgcgatctcagctcactgcaacctccacttcccaggttcaagcaattctcctgcctcagcctccctagtagctgggactacaggcgcacaccaccacatccggctaatttttttttgtatttttagtagagacggggtttcaccgtgttgcctaggctggtctcgaactcctgagatcagggaatccacctgccttggcctcctgaagtactgggattacaggcgtgagctactgtgcccagcccactcaaggtcatcttctaggcttcaaggccatgggccagaaaccagttttttcaagtaatttttatttttattaaaagatagttgaggaaagaaagcaggatgccagccagccagccaagatacatgcagaggtttttaatacatacatcctatagttacgcaccatttctccaagcacttataagtaccccaattcacctgaccctcccaacagtgccatttattcccctcctcttacagatgggtaagcaggttcccaggccttgggagaccattgttccccatacctcctgactcatgacaagggactgttcccagagaaacacttctggactctctgccccattctcactcctctaaagggggaggggcatacttctgagactggtgacttgagtgaaaggactgggcctgtgaagctcagtgccatgctatctgctctgaaaggcctgctcacagagagggcacagtctggtttactctcttggctgtgctgggacttcagtggtaaagacctgtcctcactgaggtcagcctgatggtttagggtaagtttaatttggggtgatggtgtggacaatgctctcaaattcactttgcagcatatgttagctggatcccctacacagttttcatcatccataaagctaacgttttggctttcacctgactcctgggtctttctcttaatttaagccatgcagggtacaaggggggtgggtagggaatgttatttactatagccatctccaacacaagtaagaatctattgtaaatagcaaagctgttcttttatttattccacacatatttattgtgtatctactatgtgtcagggcccaggttttaaataagagtcctcatcaagtatgtattttagtggtggagaaaggcatttaacaatgaaatgcacaattacatggcaataaggacaaagcaaagaagcgtgggatgctgggagaatgtctaacagggagcacgacatagtcttgtctggaagttgaaggttgttttctctgagcaagtaatatttaaacaggactcagggattagcaggaagaggccaagcagagtatgtatgtggggaagaatgagggatgatctcttcacgtggtacttgggaacctgaagggaggcaggtgtggctgaaacagagaaacagaaggggaatgggacatatggcaagatgcagctggtaaggtaggccaattgtgcaggatcttgtgggtcagattgagaataccctaggtgttttctaaggtctagagaagatcttagaaatgagaagccattgaaagccttaaagcaagagtgagatacactgagatttggctttcacaaaggtcaccctagctgttgtgtaaagaatggattagagctgaggcaggcagatcacctgaggtcaggagtttgataccagcctgaccaacgtggcaaaagcctgtctctactaaaaatacaaaaatttagctgggcatagtggtgcatgagcctgacctggtgtgagtagccccagctactcgggaggctgaggcaggagaatcgcttgaacctgggagatggagattgtagtgggttgagaatgcgccactgcaccccagcctcagcaacgaggtgagactctaagaaaagataaataaatataaaaaataaaattttatagtagccacattaacaaaagaataaaacaggtaaaatcagttttaagaatatagaccatttagctcaatctatcccaaagatgatcatttcaacaggtagtcaaaataaaaattattaatattttacatgcatttttaatacaaagtctccaaaatccagcacatctcaacttgagtaccagattttcttattagtacttgatctgtgtttaaatttcataaaacttgtagttgaaaaaaatattcatacacttaggtcatactaacaaatttgaaagctttccagtaactgaactgagtatctgtttttcaatttaaattagtccacattaagtaaagttaaaatgtcagttgtttgcactagccccatttcaagacctcagtagtcacatgtagctagtacctacacgtattggacaattcagtcctggagaatctcatctgtgtagcggggcgtgggagtcaggtttttcagacaccaagggccaagaaccgttcctggcactccaggcctgcctgcgattgggcagagcagactctcacagccagaggaagccagaggcagttggtagttaggtagccatagaaccctgatgaaaataaaacccaaagggaatagggaagggatgaatccactgcaagagaattcatgttggaaacagtttatagactgaacaaaatgagaggaaaaaagagagagaaatcaaatatgatttgtaggtttctggcttacaattgtgtgaatagtagtagcatttactgcgataggaaggatgggaggaggccttggtttggaaataaggccattggtttgattctggacatttgagtttagagttcctgtgaaagatccaagtggtgatattgagttggctttgagatgggccagctgagagatcaagaaatatttcaggacagtttagagcttgactaataaaaacaacgtatttcacttgtacacagattttctttaaccaaatgcagatcaaaaatacagtatttgagggatataaaacccacatatatggagggccgatttttttgtacaagagttctgctgagcccactacaggacttgagtatgagcagatttggatagacttagaagtcctggaaccaatcccctgtgtatactgagggacaactataaagggaatgatcagatatgtgtatagtcatcttaaatattatagcatagctcccaggctgggcacaagatgaaacaatggccaaattgcagatattaatatttataggccaggcgcaggggttcacgcctgtaatcccagcacttcgggtggactgcttgagcctaagagctcaagaccagcttgggcaacatggcaagatcttgtctttacaaaaagcaaaaatatttagccaggcgtggtggtatgtacctgtggtccctgctactctggaggctgaggtggaaggattgcttgagcctgggaggttgaggctgtagtgagccataattgtgccactgcactctagcctgggcaacagagcaagaccctgtctctcactgtccataaatattatatatagatacaaataatgtggttattgatggagcctcatctgttgtgaggcaggattggctcacagcactcccctcagtttagatagaaaagatccttcaggaatgtatgttcccctttgctctccgagtccaagtaccttttgttgacaaatgatagtaaagagagctgtcttgggtaaaggacatagtcttcagaaagtgcactctcattctaaataatagcagccttcagatttatgctgtcttcttctgggtgtttgtttaccttgggttagtctttttgggacccatcaactctgaaggtcctgtttcatgggacaaagccgctattgggcacatgaaaagctctccccagactcaactgatggactggagaagcaccagaggcacagctcacagcccttcagacccagcatgctgtggaagtcaagcttggtcagctggccttgcctgtaagcttgctcaggggcatagatcgctatatgagtactcttcagatagctttctaaggataaggccaccgaataggtgatccagatgatgaggtcttacaggatttaacactttgctagtaggttttgttccattaacttagatgggattgcagaaaacacaccttgaccacatggtaatagtcctgatggctgtaaaatcacatctaacacctttacgcagaggaaataattcagtgtcaatcatttgttcaactcaaactggtaaagtgcctacattttcccaggccttgtgcgaggcatgggactcagagatgagcagggcactttctgtttccgaaacaatcagaggagagtatgctagaaggtacaacaaatgcaggggatcccagaaatggggcctctagctcaggctgctcagggaggagaggggtgtttcctggagaaataaactgcttagcggaaactgctgaggaaatagaaacactggagcctcgtgttcttgggtcagagttggacccaggaactcaggcttctacctcctggaaggtgctgacctccatcagccagctgaattagcaccattttatctacagcaagatcaagagagagtctgtggcaggaagtacagagcctggggactgcgaagaaacagaaaactataataatactgaagccctcagaaccagagaaggggacttccagggtgcaacagaacaggtgtttgggagttggcaggttataggcactgttttccctttccaaaaatgggagaaaggtaagtgcctcgagagccctgtggaggggcctggtgtctcggggctccctgtttgttacccctgctctgccctacatcttcccagatggaattctggccacaagttatcaggttgcagatgaatagtgaatactttttttgaatttcatcattcttccccctagaatgactcattacaaattctgcgtccatgtgatgcattaatattgattaagaaacaggtgctctcagattcaattagcaaaactgcaatgattcacacagggttacgctggaaaattgggggaaaatatgcaggtgtgcaaatgagcctaatctgaaggtgctgcagcaggtcttgaaaaatgcatcccctccagcaaatgctttcctggaattaccctttgtttgggtgacaaatggacttgccatttcaaccaaacagtgaccccaaacctctgtggcttaggatccagtggaacttcacatttggagtcagacttctatgtcgggattcccaagctttcctgttgaaccactgcagctgtttgtgaaacacacagcttccttggccccaatctaggtgattcaaattcatggatttaggtgaggaacctgaaaatctgtaccttggaaagtaattcatgtgcctcttgtcatagacaagttagggaatgtgcctcaggagaaggctggaaacttggggctgggaagtgctgcctgcggttggatgatggtgggcacctcagcgacatcagccacccctttctggcttggctttgccatatgtagtatccagaggctatatctctccctgtggatgctgagtgagtagtgttctgatctaacacacataaaacaggaaggaacatcacgatttggcaattaatactttttaacagaaaaaaaactttaaatagattctagagtgtaatcatagacattcaacctggacttctagaacattcttgggcttctttctagcaaaacctcctttgacaacaaaagagagtttgtgacttagatgtcttcctgactgtattttagagtgctaaacttcagtcatagacatcagagtctcatagaatttttagggcagggagggacatttgagataatctagttcaatcctttcatggtgcagaggaaggcatgcaggctcatcaaggtggagagacttgctcagtgctacttgggaggtaagatgagagaactaaagatgagacagcacattttccgagtcttggcttccagctcccagtgcctctttctggccaccacactgtttctgagatcccctcattatttgaccacagtatgctaagaagcagggaaatcagcaaggacttcattttctttccatacatattaagtgagagcccaatatattcaaggaattgagtggcatgatgaggggtaaggatgcaaggtcacatggacacctaaatgaacaactgcaataaaatatgacaaatgcaagagtagaagtacacacggagcagtggcaactcaagagagaaagtgactaactcctcgaaaaattagggacgtcttctcagagggtattgagtcaaaagtcaaatcttattatgtcctggtgaaagaaatggcacacctggcagaaagaacagtgtgagcaagagcctggaggtttcgaattctaaagcaagtgtcagcaaacattttccgtgaagagcaaggaagcaaagatcttaggatttgtggtcatatggcttcaactctgttgtggtagcatgacaacatgtaagtaaatgggcatggcagtgggctaataaaactatttacaaaaggaggcagagagccatatttggccagtgggctgcagtttgttgacactctcttctaaatatgtgtctatcataagtagttcaggatggttggagcatagagcttggggaggaagaactgggagggaaggcgtgacaagatgaatctgatcagcttagtaaggacgagatcaagaagggactccaatggtaaagacatgcttggacaagtcatttatcatctctgagccttacctttctcatctgtaaaatgggaataaaaataattcctgagaaggactgttgtggatattattataatatctgagataaatccagcacagttcttgacatttactgagtgttgtaaaatgttggctgctattcatggcactttctccataattgggatgcatttgaagatggagatgtgggattgtcatgagttcggaaataggctctagaagcaaggtgttttgttttttccagcaggttaaataaggaaaagagatgctatttggccatgagtccagaggggaagtcttcaatggaggctctagatcaaatggcctcttattatctgaactcacttgcattaataatgatgaaaatctacttgttcatttcctccactggactttgagttccttgaaagtggaccaattcatttgtcatctacagaaccagaaacacaataggactcaatgaatggctaataaagatgtctttgtatctgtttctctgtctgcatgtgacacctcccttttcttttcccctttaagtcccacctttatccctatgccatatagactttgctgttagaacaatcatgacatgtaacagtttttgaattcttactatgtgctaggcataatccttaacaatatatgtataccattttatgtcttatataatgaggtaggtattagataacattgagataggtattgttattattcctattttgtagatgaggaaacagggctcagaagatttgctccaaatcttaacagccagtaagtggcaggactgggatttgacttatctgactctcaagcctgagtttgtgcactgtcttccgatgttctaattcattccatgtacattagtctctttccccaatcagactgtttgctgaatattttatttctttcagtacccaacctaatgtggaaaagcagacatttattaaatactcagagacttaatttgaaaagacttttgccccgtggtcatctgaatactccaaagaatgtactactaacttgttctcacctttgggaatcaccaatcttttgtcatatgggaaaaatgaaaatatttttatctgtttatatgctaagcagcattataacagctgcctgaaaatctaggcttcccatccatcacacaagcacctggatgctgtaatcacagatgacaaaccagctcatcagtgaggtctctttgcagaacaggtttgatactagggatcttcatggagaaaacattttctccatcaaaatgaaatgaaggcccactggactagaatcttccttttaacaatggcagatggtatccagcattggttcatttctttctgataagaaaaggccaagcttgcttctttcatctcttcattctccatggagccaggaaaacagaaagaaaagtatgatagatgtgtgtccattttctgattgtccagcgtccaacccccttgaccaagagggatgctgtctctcctccagtgtgtatgatcttggcaggaaagcaattctcaatgcctgtcctccactctggaaacttggagcttagatccttccaatattcctggttcagcagggaggcaggatgttgcatcctgagtatgtgatagcaaatggtggcttggcagacatcagcttgacccagcagtggtagagcagtgatggtagcagtgacgtatcagtgtcactgacagcctcctgaccagcatgtggttgtctctgatgcttgacttcccttgctccaagtctgctcttctaatttcccaccaatctccttccagaaaaatctccattttgcataagacagccagagttgatttctgttgcttgcaaccatgaatgctgagtgacataatatgggaagtagactttttatctacaatcacccagctgactgttgtctaaatagtcatctcttttccctggagttgttttactggctgaagagaaatgatttttttttctttccttcccatatttcagggacaatgataagcagggtaatgcccccaaagcaggaactacattgaaaatgaatacttattgaatggcccattagagaagtatgaaagctcatgttgcttttactcattgctctattctcaaaatgtagaacagtgtttcacacaccctgggtactctgattaatgaattaattacatggtacttattaatggctaaataaaaactcagattttcacatttagtcttcacaacaaatatacaaactagcaaccactgtctacattatacacataaagaaaccaaaccccagcaaggtcaagtcgctttcccattattgctgattaatgttggagttggaattctcagtaaggaccacctaactccaatccaggctttttctattccctatactgaggcaggcaaggagaataagaaagaagaaggaaaaaaagaactgaaaagaaagaaatagagaaaagaaaaggagacaagaaaagaaaaggcagtgaggtgaggtgaaggtctggttggtttaaaggggggtccttttccttggataaatgagaatttccagagtcagttctttctcagatacaaatggcagaagagggtgggctctgttaggtgctgaggttctgcagtgggaccaggaggctgaggttctgaggttcatcctggcccagagagagcaggtgtgagggggccgctgagcagacagcacagcagttcccatacacagctgtgtaggagcaaggctggagagctggcctgctctccatctttagaatctgcctactgggctccttgaaagaggaggggcctgccagggaagtggagtgcagcggggatggtacagggagggaactgcttcacctagcaggcagcactgtgtatatggtacctgaccccccttctctacctctccttgtctaggggttaaatattattattcccattcttcaggcagggaagcaaaccagacagcttcagttacccaaggccaagtgcccattgtgaactctgggagttctcagaggagctggctggaccccatggagctggcaaacccatgtatgtggaggtgacatttatcttctcagccaggaaggagcacgccatccagctgctgcccagagcccaggagaaccctgcagcactgtgattctcattagcctctgaaaggtgtgagggaaacatggaaggcagttatgcctggttttggaaattagggaggtttaatttaaaatatgtcagtttaaaacagctctcatcaaaacctactatggaacactaggacttattctgtctgaatggattttttatccactaaccgacctctgtttatctctgtcttccgccccttcccagcctctggtaattaccattagacactcaacctccatgagaacaactttttctagctcccacacattagtgagaacatgccatatttgtcttttaatataattttttatttttaggttttgtgggtacacagtaggtgtatgtatttatgcagtacaagagatgttttgttacaggcatgcaatgcataacaatcacatcatggagaacggagtatccatcccctcaagcacttatcttttgtgttacaaatgatccaattatactctttatttaaaaatgtatacttcaattattattgactatggtcaccctgttgtgctatcaaatactaggtcttattctttcattctagtttttttgtatcccttaaccatctggaccaccccgaagtcccccactatgcttcccagctttggaaaatgatccttctattctctatctccatgaattcaattgttttgatttttagatcccacaaataagtgagaacatgcaatgtttgtctttccatgcctggcttatttcacttaacataatgatctccagttccacctgtgttgttgccagtgacatgatctcattctttttttatggctgaatagcactccattgtgtatatgtaccacattttttatccattcatctgctgatggacacttaggttgcttccaaatcttggctattgtgaacagagctgttacaaacatgagagtgtagatgtctcttcgatatactgatttcgtggttattaatcccttgtcagaatatataaagagttcaaataactctataggaaaaaatgtaatccaacttaaaaatgagcaaaatatttgaatagacatttctcaaaagaagacatacaaatagtaaatagaaatataaagagttgctcaacatcactgatcatcagagaaatgcaaatcaaaactacagtgagatatcatctcaccccagttaaaaattgcttatatccaaaatacaggcaataacaaacgccagtgaagatgtagagaaaagggaaccctggtacactgttgggaatgtaaattagtacaactactatggagaacagtttggaggttcctcaataaaaaccaaaaatagagtaccctttgttctgttcaactggcctatgtgtctgtttttatgccagtaccatgctgttttggttactagagctcagtagtataatttgatgttaggtattgtgattcctccagttttcttctttttgctcaggagagatttggctattttgggtcttttatggttccatataaatttaaggattattttttctatttctgtaaagaatgccattggtattttaatagggatcacattgaatctgtagattgccttgggcagtatggacattgtaacaatatggagtcttccaatccatgaacatggaatatctttccactttccatttttttggtgtcctcttcagtttctttcatcagtgttttattgttttcgttatagagatctttcacttatttggtatttaaattcctaggtatttaattttatttgtggctattgtaaataagattacttttttgatttctttttcagattgttcattgttggcatatagaaatgctactgatttttgtatgttgattttgtatccttctactttactgattttttaatgcgttctaacatctttgtgtgtctgtgtgtgtgtgtgtgtgtgtgtgtggtctttaggcttttccaaatataaggtcagggaggacgcattggctcgtggctgtaatcccagcactttgggaggctgaggcaggcagatcacttgagcttaggagttcaaggccagcctaggcaacacagtgaaacactgtctctatgaaaaatacaaaaattagacaggcatggtgatgtttgactttaatcccagctatttgggaggctgaagtacaagaatcacttgagtccgggaggcagaggttttagtgagctgagattgtgccactgcactgcagcctgcgtgacagagtgagactctgtctcaaaacaaccaacaaaccaaagatcatatcatctgcaaacaaggataatttgacttcttcctttccaatttggatgccctttatatctttctcttgcctgattgctcttgctaggaattccagtaatatgttgagtaaaaacattgagtactaacatattactcaacatattactgaaaagtgggcattcttgttatgttccagttcttggaggaagggctttcagattttccccattcagtatgatactagatgtgggtctgtcatatatagcttttattatggtgaggtacgttctttctatacctagttttttgaggatttttatcatgaaggaatgttgaattttataaaatgttttttcagcatttttggaaataatcatattgtttttgtccttcattctgttgacatgatgtattatactgattgatttggtaggttgaaccatctttgcatcccagggataatctcacttggccatgatgtatgatctttctaatatactgttgaatttggtttgctaatattttgttgaggatttttgcatcaatattcattagggatatcggcctgcagttgtctttctttgatgtgtctttgtctggttttggtatcagggtaatactggcctcatagaatgaacttggaagtattcccttctccattttttggaattatttgagtaggattcagcagtgaagccaatcaggttccaggcttttactgggagactttcaactatggcttttatcttattacttgttatttgtcttttcagcctttgaatttcttcatgattcaatgttggtaggttgtatgtgtttagggatttttccatttctcctagattatccaacttattagcatatagttgctcatagtagctagtaataatcctttgaatttcactgatatcatggttttttctatttttcttttttttcctttttttttttgagacaccctcctctctgtcacccaggcttgagtgcagtggtacaatctcagctcactgcaacctccacttcccaggctcaagtgattctcctgcctcagcctcccgagtagattggactacaggtgcacaccaccatgcctggctatatttgtgtgtgtgtatttttagtagagatggggtttcaccatgttggtcaggctggtctcgaactcctgacctcaagtgatccacctctgccttccaaagtgctaggattacaggcgtaagccactccccctggcctcagtggtatcagttttaacgtctcctttttcatttctgattttattcggattttctttttttcttagtctgcctagaagtttgtctattttgtttaacttttcaaaaatccaactttttgtttcattgatattttgtattgttttcatttcaatttcatttatttctgctctgttatttattatttcttttcttctactaattttagggttggtttgctcttgcttttctagttctttaagatacatggttaggttgcttatttgaaatttttcttcttttttgatgcaggcacttggagccataaacttccctgttagtactccttttgctgcttttgggtatgttgtgtttccattatcatttgctccaatatttttttcaatttccttctgaatttctttattgatcctctggtcattcagaagcagattgtttaatttccatgtatttgtttagtttctgaaattcctcttgttgttgatttctagttttattctattatgaccagagaagatgcttgatagtatttcaagttttttgaatgttttaagacttgttttgtgtcataacatatggtctaccattgacaatggtccaagtgctgaggaaacaaatgtgtattctgcagccactgggtgaaatgttctgtaaatatctaccatatttgtctttctgtgcctagcttatttcatttaacatgatgacctccatctaaatgtttgagggggtggatatcctaattaccctgattcgatcattacacattggatgcatgtatcaaaatatcacatacactccataaatacgtgcaattattatgtatcagcaaaaataatctttaaaaaacaaacaaacctactgtagagcatttccacagagtcccatatctcctcctttaggatgatttcccttgaacacttcaatggttcttagaaggcaaaagcagcagctttggaagtgaatagacacagattaaagtcctgattctacacagaattatctgtgattctgggcaaagtaatttactcttctgcctcccacaagcctcagtttcctcccctgaaagattgggataaaaacctacctcaatacctctagatagaatgtacacctacagaataactaaataaatccactctttctttcttcctttcctctaacattcaatggcatgtatagtgtttgtcatacaatttaattttcaattacagttttctttctttctttttttgagatagagtctctctcaatcacccaggctggagtgcagtggcgcgatctcagcttggatcactgcagcctctgcctcctgggttcaagcaattctcctgcctcagcctcctgagtagctgggaactacaagcgtgcgccaccacacctggctaatttttgtacttttagtagagagggggtttcaccacgttggtcaggctggtctcgaacttatgacctcaggagatccacccacgctggcctcccacagtgctgggattacaggcgtgagccaccgtgcccggcccaattacagttttctaataagagacatttacatcatggtaatgctttgatgctatatttatttgtaatttattgtgtactaacagattatagctgcagcttatagatgaaagcttagtatttcatcatgagtttcttctatgttccatcaacaaatcctggcaagtagcagcttctccaaggccacctcctttgcatgcaacactctagcacatgctgcatggtttacagctccctgagctcaccacctgctgcctctgagtgtgtgctcatgatactccctcagttttgaagcctgtttctctgcccactcttgcctccactccacctgactaacatatcctcccttccttggggaagccttctctgacctcatcctgtaatggttccctaagcctgtttcacatgccaagtgctcatacacaggtgctcatgacactcacacttagaaactcattttccattttccatgcataggatagtaggtccacctcacctttacccttgtaaggggcctgtgaaacccagcaaatgactctggttcttagccttaggagatattgtggagatggctcactaagggatgaagatcggtgatgtccctagacctcttctctgtatgagtcacattatcttacatcccattaccctaagggccctcccgggagtccacaggttgtgccagcagcagccagctccagccttgctctgctgggtgaagctgggtcagtgtctaacttagtggcctccttggttgctggaaatgggaggagccatcgtgcatcagatgcttggactaaccaagtggggagccaggactcactctgagtggtagctttctaaatctgcaaaaactagagtttccagagccagggaccctggtttaatgtgctgctttgctggagcccgagcctctgatttcccttgttcagctgggcccatgataacttgcctcaatgatgcgaagagaagggaactcagcagatctaatgtgcctgctgctggaacctggctcctgcgtgaaacaggatgacatgcctgttgtagcaactgtcctctgagttgcagttaataaatctctggctgaatggatacgtggttgggattatacctcttgcatttggcaaatccataatgattcaccctcctgacctgtcactttcccagttctagtgagcattcttttctctctgctatttgtctaccttgaacacatttcttttcatgaattcaccaaaaatgaactgcaatttatttgcctgcaaatgcaagcagctgtgagtaccttgagggcagagattccgtctactcatctttacactgggaaaaacaatggaataaaaaatatattggtggccttaagtgtgtgtccagataaacttagtctcaaattcattctgttaccatgacaaggtaagatgagtaggtggatcaattttaaaggttctaccatctgtgcatctcattcatattaacatttgttaacaatgaactaaatgccactttaaagtaatgaccaacatctgtatagtgttttgcagtacatcaccaccttcaatattatctctgttttgggggcatggaaacttattcaggagccaacttgcatggaagcagcacagtatactgcttaagaggatgcactttgaagtgagacagactgaggtttaattccaggcttccccagctacatgacatgtgatttgggacaagttacttgacttgatttagccttagtttctgcatttgtaaaatgagaacgaagatacatacctcaaagcacttttggaaagataagtgagtttatgtaagtacccagaatatagtttgttctctgtgcatggtaatggtaatggtactcttgccacatacctcctagtaaatagaagagctagactaaggtctaggcattccaaatttcatgactcatctattgtaccagtttaatattacctaatagaacagttccccattttaaatttctattcaaaaccaattcatgcaatcaaatgataatataacaaggaatgctcatatttctatcttcatttacaaagttaaaattaatattccatctgtatattcattttgattggaatgcagagtgcctggtgcacagtgggtgttcaactaatgtttgttaaataaaattccctgtgaattctccccttgcaagtgctagacttggtaactgattataacaggagaatatcaacataatttttttggattgcctgaatcaattccattctttctggcccactttagggaaactgtcaatgacgaagaccctaaggaaactcatctgtggtccataaggagatgaatccccatgtctggggcatcatgttcactgtggcgccaccaactcagatgaccagacacaaatgaatttctcatggtactgtggtggaatcagctgttttgagttaactacctaagtgaatgttctatttttcccacttactattcatagaattctttcttttaatagcttttgaagaccctgtaaatcttttcaaatttttgggattaatccacttccactgtgtttccatggaactttgcttgaacctttattttagaacctatgtaattctgatttgtattaaaattctttatgcgtatttctgttctattagatgttaagctcttgacaatagacacttatataatctttgcacagagaaacatgcatgatgggtggggctgggaaggaaggagacaacaagtgagagagaaataaataaagagatgctatattgtgtctactccaagttcaggtattatgccagatgctttatagctatcacaggtaattctcatagaagagaaggatattactttctcggttttaccaaagagaaaacaggcatacagaggctaagcaacttcctccaagcaatgaagacagcaaatggtggagctagaaatagagaccaattctgtttagtttcaaaatccctgttgcttctccatctccatctcaatgttttgcacaagacagaggctcagtaagcattgaaacaagacctgataaactcacttgcaaataggaggtatgtgatcatagctaagcataatcaaatcatttaacagcttcaaagtacttgagcaatagaagattggtggcagcatatgtttgtctgaatacctacattatgaaaaggcaattcagttagatagaaagcaaagacaaaattaatgaattaagcttcatgtagaagcctagccttagttgctagatttgtgcaaaacaatcatcctagcatgctgttaattgttttaaaaaataaatgaaccggtagctattaattacgctttcatacatctgaaaaagaaaagaaaggaaaataagcaccaagatcaacacaaccagtagagaggctggtctgcattatacagtgaggagtcataaatcatgtgtgagtaaactttagagacgatcaatatcttgtttaactcttatgacaactatatagcaatagagcaatattgtttatacagctctttgtcatcttaacattatctcaaattcgcataaatttgtattctccaaaagactatacggtatatattattgcctgcatttcactggagaggaagcagaggttcaagggtgtaagcaacttgcccaaggttggccatatttaatgcaagagcaaagaagagaaatgcagaccgttaaggaactgcttttcttctaagaattttgatggttgtggtgaggtccatggagaaaagttgattactccagtcacattatccctgtctatgctgttccatctttcttctctctctatggccaatgcagaggacccaggatgcctcacatgtgaattcaagaaatggaaaatttcgctttatggtttaacataaacttggggtggaggggaatggggagaatgctgggctatgaacttcttgcactgcctgaatgtcctgacaacttcctttgtatgaatggccattgggggaaaaaatcaaggaaacaaaaaataatatgttatggaaaccatgtggttgcagtttcacatgatgggggtgggtttagggttatttgcttgcccctatcagttagccacatgttgaaaaggaggaaggaccacagactgcaacaaactgaatcaagactggaatgataatccctgacaatctttaatttgctaaaaacttattacattatcacccaagaggctggataccccacagaaaccaggttttgtcctgtgttgaaactgttggctcagatggagggataaaacaaaaagtttgtttggttagaggttgagtgcagagacatttgctgtagcttggtaataaacttgtctcctgcacaatggacagtagaatcgctgaacagctgttgattggtaaattagtatagagacccacatggtatctgtagaggagagacaatttcttttcccttgtgtctttcagacagatgtttggtgttccttgtgctttctttccttaccatctcatttctgacctttctttgtcaactgtgcattcagtgtggggttatcatttacctacctgctgtgcctccatctgccttccaatgcctgagcatgctcagattctggacatccaatgcagtctgatgaggatttgcttttcagagtccttttctctttgtacacaacacatcaaatggcaaatggtgactgtgggacccacctctgcaaagtcaacagatgccaggtaggtgttcggaaaaaagctgaattgaactaggcaggacagatatttgcaaattaaaacaactgctttcctgccagggttttcgttgggtctcgaaaggcccatggagagaagttaattacaccagtcaccttgaatttcttgaatatcacaagagggaaaggtgtgtttttagttggtttctggttccattgtgaacaacaaaaatgagcctgttaacagggcattatgctgcctgcatgctcccatgtatagacaggggtgtaagaactggaaagaaagctgctggaagtgccccttcttcattctaccagtagaaaactgaggtcagagaggctacatgcttggttgaaggtcatatagctaattgtggttgaggtggatgcggagactacgtcattttacccctgggttggcaggtgtcaccccactatattgtattaattttaatttctctgtattgggctgtaagactcctcctcctagtcaactagggttctatttttatttaaaatttaatcatatgatatttactaaataacaccaaagacataaaaccatataagtatcatgtgttatatatctatatatacactacatataacattcaacatcatcaatttccttattctttcaacaaatatttattttgggcctgtgtgcaaagcactggaatagagattgtcagagtttcaaaggtaaatataataaatctacagtggggtgaaaaagttgagaaattaaaaactaaagagtacaacccaggaaatgtagtaattgcagtttaaccaaaggcatttccatgtctgtaaggcaagatacttgaggattttcaaacatgtgaaatcctcactttaaatagggtttattgtaaaatcttagttaactagagggaattatctgggactctcagttgatcagaactgtttttgctagttctgctttgggagaaagagaccacaaagaatgcaggatggcatcaggaaagaggctgggttcacttccagattttccagaagttttaacttctctatggctcagtttcatttactgaaaaaggccaatgtgaagcttcattgtgtgggtgggaggataaaatgtgtgtaaagtacccggcccagagtctgacatacagcccctgcttagtaaatgcttattttcttagatctcatttctaaaaatgcacttcctgaggaccttcctgggcttgatccatactcaaagctgtctctggtgccatctacaccataagataaaacagtgaggaccaacattcgaaatgatggcagcaaggccccaggaactgtagccatctaaacacaattctgttctcactaatgtgttctgattaccaaagaggagcaatggagttacacattttggaagagctttttagccagagaaaaggaaacacatttttggaagggctttttagccagagaaaaggaaacacatttttggaagggcttttggccagagaaaaggaaaaagtatttgccacatagtcaaccagaagatttaatgactcagaatacagtggctacaagaattgtgggtgactgaggttttgttttatattaacagaacaaaggtgcctttggtgcaggtctgtgtttcttggcatcacttcctccaggaggtaaaggacccaagtgcctttactaaaaataatttctcacagatctgtccagtgctgacagagctcagggctgaccccagggaggcacaaggtgacctctgcatggccttcatcctcactcgtggtggtcacagggcatcagtgtcctgggcagttgtaggaaggaataggtgtgagtgtccacatactaatgcttccaaatgtgtcaaatctccctgctttccaaaaatagattttgtgggtagattgaagtgagagagaattcaaagcacaagaaaatcatggcataaaaaaggcacagaaagcagagctattgatcaggagctttattttatagaacggggcttgcagtctggaatgagacagaggtttctagtaaatagcagcagtgagactggaacctgggggtgctgatttttcatccagtgtttttgctgacatctctgtgatgacctggtccttcaccttctttcctaacgccacccgaggacccctaacatggagttagatgttaccgatggaaagcattgtacagagtctgtgttccaatcctgttctttttttttagaggcgaccactgaggcccagaaaaggggaagtgccttgtctgcgatctcatggaagttaatgagaaagcctgacctagatcacctgccctatcatagacccagtgccatttctactgcagtgtgcaaagacttcaaagaaggccagtgtgctcccctcacccccagggattgcaagttcaagtgtcctgtctgcactgtcctgaggccattctaggccattgtgcagagaaatctatattctatggggtgggggagatagggaagagattgagtcaacaaaacagattagtagacctattactccctagtcttagtacttttttaggtaatttgagtaaaactcatgaatcctagagcactttaactttgggttaaatgtaagtccacaacaatagtcacaaaattgtattgctctgggcttctctacctatagttagggtgtctggaactcttcaaatgagggaagtcattctcctaactttaatgtaacatctgtcatttcatcctcttcctctccaactccctgtagtcttgtccattgctaagcccgcttgcatccatgcaaggagccctctactttcacacagaccacccacaaggcctggagaggtcacagcaaagccagctcccacagcaattagagacattggcattttcttctataaactatagaataggtgtctttaaagatgaggataattgttagggtgacctccctaacaattattcagtcattattctcatctttaaaggcctcctttttactgccagaagcatctcatacacacttagatttctagccacagaccatctgccagctgtttctgccagaacagctgcccatcagaaggaagatggaccaagagagcctttgcacagctccagagtgcatctccagcatcagagaggcaggcagccttgtcatgggtagctccagcggttggtggatgacacagccaacttggacatgaaataggcactgagggcattaaagcagcatgaaaaaggatatccagttgtccacacagtacagtgtgctgctgtttctgtggacttcccacggtcaggcttcaaactctatcttgttctaaatcatagcacgcaggcgcatgcgcgcgcacgcacgcgtgcacgcacacacgcacaccccgccctccactaactcatgaggtgacctgacctgaggatcattgaatccagtcgttcttaaacttgactatgcctactgaccatcttgggggcatttagaaatcacagactcccaggccccaccacccctggcatactgaatcagaattatcaagaggtaaacccctccactcccttaaaaagaaaggaagaggccaggcgcagtggctcacacctgtaatcccagcactttgggaagctgaggcaggcggatcacgaggtcaggatttcgagaccagcctgaccaacatggtgaaaccccatctctattaaaaatacaaaaattagccgggcatggtggcatgcgcctgtaatcccagctactcaggctgaggcaggagaattacttgaacctaggaggcagaggttgcagtgagcggagattgcgccactgcacacctgcctgggtgacagagcaaggctccatctcaaaaaaaaaaaaaaaaaaaaaaaaagaacgaaatctatatttgacaagagtagctaatctaccacacatccacgactagcatctaggggctactgatcacagttcaaatatccacccctccctgtagtttttattgaagaggacacagtggctctgggagaggaagtgacttgccttaagcaaagccctgacagaaatgggactacgagactagaaataaatgccttcacctcttttgttttgctccttcgcacaatgcacatgccctgtcccttaatgatggccacagcttccttcctatttttctatattcataatacaacacatggacatttggctgggcaagcacatttattgatcaaaaatatgtaatcctccttccttatagaagctcaggttccttctacgttatttaggtgggcacctcaaggcgctaggaagaccctaaagctttagagatcagcctctgaaaatgtatgaatactgttgtgcatgtgcatctgtgtctgtttcaggcaagaaattctgtaactttcatacatgcccaatggcatttatctacatccctaaaatggctaaaacttctggtttacaatatccctaataagaggctactggtttgaaggagatggtttagaacacacacaaaaaaaatacaaaaataattttacttgagagatgcagcttaagttactcctttttggcacatctaactgtgccaggcatagtgaaaatgattgataaaatgtcaagatagaaaacacgatcataaaagctaatgcagcttgagaatttttttaaattggtttaaagttgcattgtcactagtgggaagcacaagtatggccaacccaaaaggcctcaaggaaaaggcaagagaagtcagagaaggctgaagacgcagacttggagggataataaaacattttatcagggcaggacttgagaggaatataaagcagtaagttttaattaaagttatgctagtacactaatttgggcaaccaagattcataattaaaattttatgccaactctgcgcatcaccaaacatttttaatggctccaggaagaacatgatgtgggtacaggatacattgcagtgaacatcaaggggagccagtcaaatgcacagggtggggaaacagtggggagtagctaggaagttttgtcccacaaactctgaaagctttcttctgaaaaatgggcagtcatagctacttggtcaaaggagtgtccaaatgtcttttgcaacacagcaaagtaccacttgctggtacttttctgctttccccaattcaatatggttcttggaaggcatgaatcacttctttcatctttttatcctcagtatttaagacactgtcttatatcagttatttagttccttaacaatgctgcaaaataaataaccataaacccccagtggcagataacaatttatttagtttataagtctttgaggttctggtgattttagctggatttgctcatgtttctgtggttatctgtaagtcatctaggcagctctgctaaactcactttgtttgctcatctatctggggatttactggctgttggctgatctagcatggtctttgttgggatgatggggcaacttggctctccaccatgaatctcatcctccaacagactcccctgggtacaatatcctaacatttccttggccacagcaagtcatgtggctaagttcagggtcaaaaggagagagtgctaccaaattatgtggcaaagagtatgaaaatagaatacagtaaataattagggcctttgatgaaataagtctcttacatgactagactagggtaaaggctcaataaaagtttgttgcaaaaactgagtatattatccaaagaagatatacaaatgtctcataggcacataaaaagaatggtcacattaataatgatcagggtaaagcaagttaaacccacagtgagatgccatttcattcccactagggtggttgaaataaaaaagtcagatgatgacaagtgttgatgaggatgcggagaaactggaagcctcatagactgcttggagaaatgtatgttggtgcagccactttagaaaacagtttggaagttcctcaaaaagttaagcatagagttaccttttgatacaacacttccactcctaggtatatgcccaagagaaataaaaatgtatgtccacacaaatgttcataacatcattagtcataatagccaaagggtgaaaacaacctggatgttcatcaactgattagtagaaaataaaatgtagtagactcatataatgaaatattattcagacacagaaaggaatgaagtaccggtacatgctacaacatgaatgaaccttgaaaacattacgttaaatgcaggaaaacagacacaaacggctacgtatgattccatttatgtaaaatgtctataataggcaatctatagagctagaaagtagattagtggttgtctaagtctgggtgggtcagagggaaatgggggtgacttctaatgcatttcttaatggagtgattaaaatgtttgaaaattgatcatggtggtggttgcacaactctgtggatgtacaaaaaaaacattaaattatacacctgaaatggaagaattttatggtgtctcaataaaccttctataaaaaaacaagaaccaaatgagataattcctttaaagttactcagcacagtaccttacaaccttggctaagttaaccatacttcataaaatctatgatgctatagattgtaagagacaccattatttaatatacaacaagaaaaacattaccaagttaactatgacagatcatcaattataagacatatcttaattttgaagatgttaaaatatggaaaatgtatattagaatcaatgaattatggcatgtgttgaagaaatagcatctgaagttaaatctattcaactgagtagatctttctgtcttcagattccatttttaggctcagatatctttcctagattaatggattttgggggtatccacctttgactcccagccttcatcaaattcggcaggtgggcccagaagaagtacttgccctctctggtcctacctggtgctctgtcattccccttacagctctatcctaggagtgcctggtctgcctgagaatctcttgtgtttttgtaggcatggatctctgagtgtggaatggacctgcctttccctcagggactggaggtcacttctgcctcccaaacccttcaagcatcttctctctctcctatgatgggatgtgatgaggataaacaaggaaagtgctttgtcgtggcaagagacatctggtccccagtggcagcttccacagagaagagagtgtaaaaccacacacatgttcactttcgtttgggtgaggagtagtcagagctgttgactaacggacaataggatgcatgaaaggtccacccatccaacttgtggtcgtcagtaaatctccagtcgcccttggggactggggagaattattttctccctcttgcaatttacaagtatcatctaggaaagataagacagtagcttcattgttggcaggctgtcatgggctttcttaacagcgtgagtgtgctttctaattttcacactagaggaaaaaaattaaaaaaaaacaggctcttcagttttgtcttccatatacgtgaatcttatatgggctgtagaattgttctgtggggacagacaatgaaaaaaaaaagtgtgatcagataccttcctcagaaacgaaatctagaaagaagagtaagcagtgtggtagatgctgtgtctacatcactacagttctcttccgctggcattttgttctggatgattccaggtgtagagcagaacttcatgaaaattatagtgcagtaagaagaaggcattctagtgccagacaacccatgttttatgatagggatctaacccagtgacaccaggaagtctttgatcatggtgcgtaagttgtgtaattcccatagtggttcttgtatttgacacatgtaagattttctttttgaagtctcaatttcattaccgaagacactgctcagagaacaattactgatagaccccaactgaagaagcttcctgggaaggaggtgcagggtgtggtctagatgcctacagttgggtatcatgactgagagacggcaaatagcattattcttcatctgggttccaagtggtggaaagtgactgcttggcataccctgtgaatgattctgaggctgctttagaacttcaggtggaaagccaactattactgatcatgcctatctatggatttagctagggcttggggtagagttgagttctgcctgttacactatgtctcattaatttcctctcagggagacagtatcctagcagggaatgatttggaatcaggcacacctggtttccatcctggttctgtttttcatcacatgatagtggagcaatttatgtaatctccctgaacttccattttctcatttgccaagtgggaaagagctcactctgccatgcactctccaaaaaggctttgtctaactcatgtgatcttcataaatgcctggcagagtcaatacctggaatctgtagaagaaagacacttttcacatggggaaattctttcccctcaggctagtgccttcagaccgagtctaatgtactctgcaggctctgcttggatcatttgtgcctgatgtctgaaaaaaaaaaaaaaaaaaaaaaacaaccagaagcactccctacatttgagaaaaaggacatctgggaattaatcctgaagttgggaggaaggttgctgagtctggattcagcctgaggggcagatggctagggatgtccccagagtgtccccacctccacttcatgtgcagatgacactgacagctgtggtgaggaagggccttgccatgtccatgccatactcattaagccatgatatctaacagccaacagctctgcaacctgtacctacttccaaggagtcaagctctatctgcttccaggctctgctgaatctgcctgtatttaagtgccccatttctttcccagaagtaataaaacagtcatctcgttgacattaagtgcggagtagcagacagcaagactcatattccaaaatctcaggaccctgccagttatgacaagacactcttctggctacagaattaacatgctactccgggtttaaatggggggattaggctaacacagagcaaaccagtttcttccttattttccctgacatcacttgagatctcccagaaaatggatagttttcaactctctgatttgtgcgcaactaggatcatcttgcaggaaggctgttcaaggagatgggtttggggtttctgccttgagaagctgataaggatggggttttctgcctagcgattactgtagcagaagtggccctaccttccatcctcctgcgatggggcctccttttcctgagcctttactgtcccaaagtagcagcaggactggacagctctgcccacagcatctcccgctcctgcattcctacattccaggcctcagctggagactacactttctccttactccctcttctctccaaatcccggcttctcagtctctctcctagacttgcaatctaatatagccaccaaaaaaatgtctgcctattttgaaatcatggaaaactgttggtttatttctaccttttttgggtggtgtgaaggaataagcaaagaaacactacattttaggaaaaggagaaatgtgtacaatgctgatttttaagttccagctttagtcagtttaggagcataaggctatcctctacgactcagtttgctaattaagtggtgattggaatattaaattttaaagtataatttagtcagacaataattaccagcgaactaattaaatttacttttcaatggttttcactttcaccgcagtgaacctgtaagttactgagctgcaaggaatcgagcatctttccttttgtcagagaagaaaaagcaggcaaagcaatgataatcaaagagtctttcttctacgttgtatttcgtatgaattgtgtagtagttaagtgcataggcccaggagctgagctatttggttcatggtatgacttggatactcactggccgtgtgatcttgaccaagttgctaaacctctctatcccccagtttcttcatattaattagtgtccatctcatagagtcactgtgcataataaattatttattatacagtttatagaatggtgcctggcacatatttaaatggtaaattagtcctatctatgatgatttttaacaatctttgtgctttctaaacttatctccttcaatgtcaagcctattaaaaaatacaaatttctataaattaatctggaggaaaaaagagaacaagaaaagaaagtcattgataacacctgccacacaaaattagccaatcattcataaattttgacctatcactgtccgcatttgtttccaatgcttctctttcatcctcttcacagaatgctgctcgcttactgagctctgagcaagttccatcccatcttgcttaccttgctctccccacaagatcctctcagactagactctccttttatttattgggtcttctcttttgaaactgctccctgtatctcattcatggtcaacttttgacttcaggtcagacattttgttttccccttattgaaataagtctctgtttctattaatatagactcccagtcttcactaagactctgccttagtttccattttcactcttgcagcttgaatagagcaccaaagagaacaaatgaatgtgcttttccaggagaaataaagttacacacatcccactgaaaatggaggagggggcctgaaaactttctagctcatttttactaattaaatacgtatgtgatgctatttatattttattatttagtaacttgtctttgttttattaccttagagaatgcaaaatcaaccataagggttttaaagcatagatttatagcactttctttaaccctctttttgccagaaggtcttaagttccttaattgcaaattttcccactttgagggtggagaactagggaagggagagacagtacttttcctgaactttccattccatattgctgggctcctctgtggggcacctgcatttcctgagtctgaggtctttccacattgccttgcagggttatgtgactgtcttgctgggacgcctggtctcagcggtccctttcagcactgtctgcatgattttcacagaaacatcttagttccagctacgtttgccactctgggcagttgtttggcaagcatgccatgttaacatgccatgttctttcatgtttctgtgccttagtgagggctttccttccatcttccactattctattcattaacttaataaacatattatgcagctactgtgtgctagcgattggggattcaaaggtgattgagtaaaagtctctcccttaagggagattttattataattcctgagaaggacaaatactgagtaaacaattgagtaacgaagacaattacagtgctgtgaaggcaataaccagggtgacaagataaggcagtggttctcagctgtggctatacatcagaatcctttggagaacttccaaacttatgggtgcctgggccccattctcagatcaatcaaatcagaatttctgggaatgaggtccaagttctagtattttaaaaactccccaagaacatttttaaaaacagttttattgaagaataatttacataccataaaattcacccactgtaagtgtacaattcgacagtttttagtaaattgcagaattgtgcaaccatctccatagttcagttttagaacatttccatcacccaaaaagcttcctcccacccatttacagtaactccccactcccacccctgggcaaccactgatcttctttctatagatttgccttttctagacaattcattccccagggagtttttggtgtagtctggattgaggacctttatgactgagcaaatgaggaagacagtggtgaagttagatctgaaggatgagaacaaaccagctgtgcaaacagtgtgtagaagagccctctggcagagggcatagcaaaggctagggcttggaggaaggaaagagcttggcccaggagcagaaaggaggccgctgcacttaatgagcaagggtgagagtagagcaagagtcagggtccagaaccttcagagctttgtggtatggtgaggagcttgagttttctcccaggagcattgggagatcactaaggggttttacatagcagtgtgacatacctcaatcctcatttaaagaattgagcagttttgtagagactatattagagggaggagaaagagggaagcaggaaggtcagttagaagactagttctatgtggctgaattcagttcattctttaaggcctgattaaatgtgacccattttgggaggctttctcagtgttcctacttttgcttccatagagctcaatttacactttcattaaaccaacaattatatgcaatcgttaataatctgtttacatgtctatcataggctatcaactcgtttggtggattgcatggggaaaaacatctcactgaacaagtaaattaatgggaaatacaataaacaaataaaaatgagaaagaaaaaagaattatatgttgtttttccttctatttctagcacttggcactatgcctggtacagtaacaggtgttcaggaaataaatgtttgttgaattgaatgatgcatctcttcaaggatcaagaccatgctttatgttttgaatccccacaacaagaagcataatttaatgtacaaaataggcaatgcataatttcatgttgcatacatgaatctaccttgagactgaattccatcagcacaaggaatataatgtgtgataataatgtatagtattcaaagcactttccttcattggggaaattgttgctgagcacctataagataacaggcattatgttatgtggtgctggctagtacctggtttaacaagatagtaagagttcccttgagagtgactgtggtcttgttgaaggaagctaaggagcaggggatcatgtaacaggcttgaagggaagaaagtcaaatttcattatccccattttacagatgagaaaaccaaggcagattaaagtgcatgtctaaggtattagttgagatgcaaacctgtgccttctgcttccaagttcttttgttggctagtggctcttggaaagaaatgccacgtctgggacacttgggcatttccctgtagaaagcaatggttgtctctaggaggcacaccatggtgaacgcttctgaagcatggaatttgcagctggaggagaccctggagagcatttgctttcgctgctttattttatagataatgaaactgaggcccacagaaatgaaaggactttctttcaggttacacaggtatttagtcagaaggccatgcattctcagagtgaaaagcccttattcattttattgttaaggaaatttagaaccagtgacatgaaatgatttgtctaaaatcacacaactaggaaatggcagaactccaacaagaacttaggtcctctagctcttagatctgttttctcaccactaatttgtagaacacttaaatgcttatatctgttgtccaccaaaagacataaaaatgttcatgccaccttttttaataatagcgcaaaatagaaataacaaaaaccttcctaagtggtagaatgagtgcttacattgcggtatggtgacaacatggaatattacacagcagtgaaaaagaatgaactactgcttcacaaaacaaacatgggtaaatcttaacagatacaatgatgtgcaaaagaagtcagacaaaaaaagagtccagactacatgatttcacttatgtgaaattcaagaacaggcaaaatagtgattgaggtcttaatagtgccagcggctatggctgatggggaacattagtggaaccttgcagggtgctgggaatgttctgtgtctggatctggtggaggtaacataggggtatcaacatggataaaaatctgccaatatatcctcttaagatctgtgtgcatttctaaatgcaagttatacctcaatagatgtaatgaatgaaaaataaagtttccactgtcatatcccattgttctcactacagatctgagaggtaagaccaggtttaagaatattaggcttagggaatttgctgaccaatctcacagcccagggaacatgtcagcctagccataagctctgcttgaaaaagctgctggttttcagtcaattgaagaaaggttttaaagtttcttagagagtttataaatgtgttaattacagtcatcaagattttgtattgcaataaatgtttatctaatgggtttaaattaggcaatttactcaatttgcttgttatttcctaattaacttctgaaatcctctttctctgacttttcaacctataccaatagagtttggatctaagaaattttattttccttttagcagtacgtatagctttttttcctttttcttgtttacccatccaaaagttctacaggcaatttcaaatgtacatctgcatctctgtttcttgaacttttgattttgttttgttttagggcaagactccttgtccctagaaaagcttactgctattatttacaatagaagctaatagaaagcaaataaatgaccaatgacaggaaaggctcaagtgaactataatgcatctgctagatggaatataatgcagccattaaaatacaacaatagcttggaaagtgcctataatattgtaagtggaaaaagcgagcaaaattgtccatatagcatgtctcaactaagcaaaattacacatgtctaaaagtaaagtatactaaatgtcaacaatgattacgtttaggtaggagaactagagtatattgttattttcctacttttctgtatttcccaaatttactttaaagaatatgcactatatttataatttcaaaaatgacatctttgaagacaaacaaaattcattttcaatatctttaaggcttcctttctaaatgtattctgtttttcaaagctattgagtttctcatattactaataactttatagctttaaatcagtaaactgaagtttattaagccctgacttggcatctagatcttctcatagcactatgagacctaaataaaaaaaaaaaatacaatgatgcaaataaaaggaacaaaagtgatagggaaaaaatagaggctaatgtaagaatgaaaacagtttattttgacctattgcttattagacccttgaaatcagttttctcataaacactccctgatgaaggtagatgtgatcattcccattcatttattccacagacatttctaaacacctattatgtgtcaggcactgtgttcaatgctggggttacaaagataagtaacataccaacattgtggctatatgtcatttataccaaaattattatacctaagaaaagtatagccctttatctcaaggaagcttgcccacagaagagatgcaaaaaacagattcagaaaggttaaatgacttgtctctgtcccacagaaggacagtgctagagccaggatttaaattaagatctcttgggctttactaacatgctctttgtagcacatccagcagcttctctgcaacatcctggtatcgaggaccatcatatgatacagacgacggatgctgcaggactgacaaactcctcagtagctggcaaagctttcctgaacaatggaggacctcactgggctttatagtgggtaagatttagatatgtggacatatcggggaagatattaacagcaggcaggtgagaatgaccccatgatcatggtgctggggtgcagaagggaaggatgtgctgggttgaggttgggggtgattttccttcagtgaatcacaactgagtccagtgaattatgtcaaatataatgcaggggctgcaataaggaatgacaaagagctggcctttgattcctcagatattcattaaacatctatatttggttgggggcaaggaatgaagtgatacatataagccatcatccatcttggaagggaaatgggtccataatcagatcatgaggccaaaacatgggacagaatgctgtcatttagctttcagcctcaaattgtcacctctgcagaaagacccggtctgtagtagtcatccagtcatttcccatagaccccaatcttaaatctatacagaatattgatcaacattggttatgtttctcagtttgtcacttttaaacaaaagtgattgcttatctcttttcattagaatataaaatccaagaaagcaggaaccatgtctgtctgatttctagctgaattcttagatcctcaaacaaagcttgaaaaagaaaacattcactaaatatttattgagttaattaagtgatttttttggagcaccaagaagggtttctagcctggacaggaatggggcatggatgtcagagaaggcttcctgcagaaggtggcagtgagatgggccttaaagtatgagcaagttctgtatggaatcagggcaagagcgagagggctgagggaagagaggaagggcattccaaggcacaggcagacaatggtggtgaaacgtgctatgcagaggagctgggaagtgtcaggcaggacttgcctaaagatgcagctcaagaagaagccccggaagcttccattttatttgaaggacaaaggagatcaattggagagtttgtaagtggagatatgacatgatcaaatcagcatttaaaaaaattcagcagtatggaaagacacattagggtgacacaagattggggatgaggttccctgttgagaaaaagtggccccttaccctccaggagctgggctgggactatcagccaggacttgatgcttgcttgatcaaaataaatattttctccaaccacaccagacaaggccactgcaattccaatgggtcaagtcaaaaaacaagatcaccctataataatttctgaacacaggttgggcacagtggcttacgcctgtaatcccagcatggcagattacctgaggtcaggagtttgagaccagcctggccaacatggcgaaaccacgtctgtactgaaaatacaaaaattagccgggcatggtggtgggtgcctgtaatcccagctagtcgggaggctgaggtcggagaatcgctggaacccaggagggagaggttgcagtgagccaaggttgtgccactgcactccagcctggatgacagactccatctcgaaaaaaaaaaaaaaaaaattctgaatgcaaacaaaaagcatgaacatcatccacactataaaaatgaccaaacagtcccctttcttggctaatatgagtggctgatttttttattatactttaagttctagggtacatgtgcacaacgtgcaggtttgatacataggtatacatgtgtcatgttggtttgctgtacccatcaactcatcatttacattaggtatttctcctaatgctatccctactccagccccctcccgacaggccccagtgtgtgatgttccccaccctgtgtccaagtaatctcattgttcagtttccacctatgagtgagaacatgtggtgtttagttctctgtccttgtgatagcttgctgagaatgatggtttccagcttcattcatgtccctgaaaaggacatgaactcatccttttgtatggctgcatagtattccatggtgtatatgtgccacattttcttaatccagtctatcattgatggacatttgggttggttccaagtctttgctattgtgaatagtgccgcaataaacatatgtgtgcatgtgtctttatagtagcatgatttactatgatttattagtaatggtttactaattacagttttaaccctgctgcattcttccagctgtgtagataagatttactaggatatgcaatcttagaactagccccatttcctgacagcacacagtccagagtgaagccctgcttccttgaactgtcctccaaagtatctaaatctgaatcctgtaagtccctcctagcacctcttgctgatatgcctcatgatatctcacactatgcattgtccctcatagaaacagcaatacactcaacctgttcaacagcagatgtgttcctgcctttgtctggaaggcaatggcaccgctaaaaggttgctgcagtcactaatatgcggaagcccacctgtaccagctcatgctgattgccaaatttttaggaattttgcaagccaagtattaaacctagcactactacaaattaagttatataaacttataattgaagacatttaaagatattaaaaacaacggtaatacgtttactaattcttttcataattttacgtttttttctggagtacattagcattggttgcatctatatggtagagatagcataaaatggtgtcctactgtgcatctgtttccaatcccatgtttagtgtcatcatgttgctgtgaaattcaccatagtgaaaatatttacaccactgaaattggcaaacactacaaaccaaggcttctgctgtgctttctccagttgattggtaaacatttactagcaccccactggctacactaatccatggatgttgaggccttgaagaagatattgagagcaaagctggagatctctggatggattcaagaaatgtttaggtgataaggtaattgatggagaaggaaattaattatctaaactcttctcctgccctctggtataaaaagtataagcatcagattttctttgtctaaggagtcctatctttgggcactgagatatccttttgtaatgctgtcctgagtcccacctgctctcaggctgattgcctgtctatggcttgagtacaaggaaaggcaagaaatagctcaggggaggattgctgacagcactcttggagtactgatgagagccatcaggatgaggggacctgcttaaccatctcccaaatagctccccattttcaactaagagaacagtcacaataggtgagccttccttttatgtcagggtctgtttagaaatacacatgatcaggttatttatttactttaaaaagttcaattggcattaaaatttcacttggactaaatcggataatagaagaagcacagagtgaacagaaaaagcacaaggtgaatagaaaagagggtcatagataacagattaaaaattataccaccaggagaggaacaaaagcactgtgctctgaaggaagcagcttcctctagtgatggtatctggcacattaatagtccaggtaattaatggttgtaaaacacttcaaaagcataaagcactgcatcaatgctgagacataattgtgccattatatcagaacgtggagcttcagtactgcacacctacggtgcaggtttttaaattgctgcagtcttggcataaatccgttggcttccatcaggcgctggcctgccccattcacccaggctgctgtaaggggccacgcctgtgcttacatgtgaaataagaagtggtcagcacatgcccctcctcccccatggagcactttcagatgatcaggacctgttcagaactccagtaactcactctcaggtgaccctaaggtcagtgttattttccatggttgtttgcatgtttcacctgaaggtctaggatcattccacctgcttctcttgccttctgtgaagggacctgcccatgagagagagctggagctttagtggattctcgataaagctgtgtgcaattacacagtgagggtgaaagctttcccctccgaatggctccactcccacactagaatcctaatgtcccataggatataccggcttttccaaccactcatgggaagcaggtattataaaaaaaattcctactttgtagataggagaataaaggctcaaaaggtcaagtcaaatgcagagggctcaagcctagctctgaccctaaatctagcactctttcttcaatgtttccaagctctcaggtggcttatgccactgtttaattttctactgccttgtttcctgctacagtcaaaatcataaccatgccaaggacagaacccactgacattgcagagagtgcttttccagagctcagagtgctttggtatttgtcattttaattaatctggtctgtgacttcatttctagctgcatgatcttcggcaagaccttaacctcttggggcctcagttacttcaattgtcacattcattaactcaacattgaagtaaggtgggcaaaattttattagtattaaattattaataaatatgcattaataatgacctcttaaacttttataactcttcagagtttacaaagcactttctcaagtgtcttcttaatctcttcttccaacagctctggaaggtcgctaaggcaaatgttactactccagtgggagtgtgaagaaattgaggcctagaggctccagaggcattttatataaaatgtgttttgggaaaatattagtccctcaagatactctatgaagaaatgtacgagtgggaaatgctatgttgcctacttagaaaaaagggcaaggcaaattaaaggctgttgtaagtcctgcggtaaggaaacctgcttaattttgtttaaatatgtttgctgaaacatataaccatgaaagagaaactgctttctctgaacacctattaatatttcataaaactaggttttctggtgctcctgttccatggaacccttagtataatcaagactaagcaatttgatcaaggtcatgtgcctggcaaaaccagttcttctgtttctgagtcaatgtgaaacattttacagccctctgtccataacaaatttaacaaccttttttgttcagtttcctagctgtttttgctcagtggagctgggcaaccactccaacccccattaaattccacttgttgccaatgaaatgctaagttacctgtactgagcaaatttcacatcactgtgtagctggcccagattctctcttgtctctcttaaacatccggccaaaggtacaggggtgggagttcagggaaaggtgtagtgaaatttctggtgtcttgttggcttttctttctgagttgcgttgaacattccagagacagtactaaacaccaacaattaggtaaagagactaaaacagcagtgctcatctagaagcagctccacccccgcctcctgcctggggacgtttgaaagtatctggggacatttttggctgtcaccccaggtgggtgctactggcatctagtaagcagaggccagggatgatgatgaatgccctatggtacaagggaaagccttctacaacaaagaattatcctgcacaattatcaaaagtgctgatgtgaagaaaccctggactaaaggaagtgagatggtttgggttgcgtgtccaattattgaggcagcttggattactgaagacagcattgttccgttgcctgagagtcagtgttcaagccctgcttcaccagagtgagaaagacttctggggctcactgccacatagttctcctctaattcctggtacagataaaattcatacagtgaactcctccctgcctcttaccatggattggtagagtcctgtcacttagtgcctggcagtgagctgcaggtgaaatgatcaggcccctaagccatccatgagaccttccatccatgctcctttttaccatctgccggtaaaatccaggggagaattctgaaatctgactgagataatgaatcaggagttcttaaacttaagtccctagatccccaagaggtcagtggatactggaatttgagagagaaaaaatgtcctctttaaaaatttatttttaagttttgcaggtacacagtgtgtgtgtgtgtgtgtgtataaaaatatataaatataatgggatacacgagatgttttgatacaggcttgcaatgtgaaataagcacatcatggagaatggcgtatccacctcctcaaacatttatcctttgtgttacaaacaacccaactacactcttgtagttattttaatgtatacaattaaatttttattgaccaaagttaccctgttgtgctatcaaatagtagatcttgttcattctttctaatttttttgtacccattaaccatctccacctccccccggccccctgctaccctttccagcttctggtaatcactcttttactctctgagtttaattgttttgacttttagatcacacaaataagtgaggacatgcaatgtttgtctgtgcctgacttatttcacctcacataatgatcttccattccatccatgttggtgcaattgacaggactgcattatttttcatggctgaatagtactacactatgtatgtgtgccacattttctttatccagtcatctgctgatggacacttaggttgctccaaatcttagctattgtgaacagtgctgcaatagatatgggagtccagatatttcttcaatatactgacttcctttcttttgggtatatacccagcagtgggattgctggatcatatggtagctctgtttttagttttttggaggaacctccaaactgctttccatgaaaaatggcctctttattgtcactaacctctaattgaaagcatttttttcattatgaatgtaagcaccaactattgtagtgttattggtatccacaactaattttctaatacaaatcagaaatacttattacatcaactatctcaaaatattatttttactcatcactactttgtaattatagcagttattggagcagctgaaagatcttgttttataatgcattgatacagaagcacacatattaccatattacaaatttgttgtatattttattcaattacaaacattattcagagaagggtccatagccacaccagactgtcaaagaggaccacggcacaaaaatattgagttgctgctcttggtggaaggagcttggttcctggatgactgcatggagcagagtcctcccttccaccaaagtcctgtcatcccacattgggctatagtataagcaaggaataagcctttcttgtgttatctactgagatattggagatgtttgttaaagccattagcccatcctgactggctgtaattaaccttgccaaaccctttaattgttctgagctttggcttccaaacttgctcttagaaagaatcttatccacacaggatggctgggaggagtaaatgggagaactggtatggaaatgcacaacagatgaagggttttttatggatcatcaagtggggctgctttttccccaagccagaggtcaacaaactaccatccacatgtttttgtaaataaagtttcactggaatgcagccacacccattggtttacatattgtctgtgcctgctttcatagcagagttgagtagttgagacagagatcctatgatctgcaagtctaaaatatttgtctctttaagagaaagtttgccaacctctgccctaggccttacttttctcctgtaagtgatggtggggagggatgcatggcagactctttatgcagataaaaagcctgggaggatgctaccctcctcaggctcagtgggatgcctgaagctgggcacaagggaacacacagcatgcctgccacctacgaacactgggccaactgaatttaaagccagaacctgtagcccctttgtcacttgcttgaactagttaactgtatcgatgcatacatgggtttgtttcctttgatgaggtaggccgacatcctcagatctagaaggcatgcatggggcagaagaccaaagctggtttgtcccatatctttgcagtggtacatcccttcatatcggtaggtagcagtgcagaagatatgctcacgcccagtctacagataaggaaactgagtcacagaggggttaagggaatataggaaggaaactaccatataaagacaagcatagtcaaagaatttgcccaccgtggtgtaattagtaagtggcagagctggaattgtaacctagcttgattccatgtccagcagtctatacaacccaacattgctttctccatcattttcactgctgttagtatcatcatctgactgcctttgtgtagtgtatgtgtttgccaagtatagctgtgacaaggctgctgccagaatggtctttcaagtgatacaagtcaacccttgtttatctctgctgttgaattgctgtgtgatcctaagtaagtcacttaacctctctgagcctcactccattcaactgtcacgacagaattgtaatccttatcttacctcactttgtaattgggaactcatttaaataagaaaggaaataagttagctgagtaaatctttcttttttaagtctgcactaaaagaaagttatttttctttgcaatattcacaaaactgacagctgccaaaattagcatctgactctttttatttaagtatatcttatttgcttgtattaccgcagcacatcgtagaatgatgtcctaaatgcccttccaacgctggcattacatctttctaaaccaacccttcttttagctgttgaagaaacaagcatctagggaggcaaaaggatttgctttgtgcctcctaggaagtatgagctgagactagaactctgatccttggttcctagggccctgtgttctccacactacttcactgactcctgaaggagggatcgctttcgtgatgatggttctctgagtgcagaagtcacacctaatgtgttccttttctttcagggtagatgtgcaacattaaattcaccagctttggcttcagaaagacctgggtttccatggtgcctctgccactgacaaaccatgggatattgggctcttttatttccctcctgcagattcttagcttctccatgtgtaaaacaagaataataatagcccttacctcacgggtgtcaagaggttaagtaagatgatgtggataaagcatgtaatgaagtccctggcatgtagtaacactataaatgcagctgttatcatagttactgttttagctgcccaacataaggctcccacatcaaaagcctcctttgtacaatttactcatggggcaggaaagaggctgtgatgtatcatcctgaggtccataaaaaggatgctaaaaaaacaagtcataagcaaccatggctatctgcccagttttataattgagaaaaacagcatcttagaaaatcactgctagtttaggtctcttgcttggaattactaaatgtgaatttaaatatgtatttattttgtgtgctggtgtcagcaagtgtgggtactgaggaaaccatccatatacactttaaacttcctgagttagatctcttgtggatgccttctttctggtcaagcgttggtattggccacttgatttaatctgcacttggggcagcctccttcctggccacagagctgatcctcaccttggtggctcccgagatccatggcaccacaaacccttactatgagatgtcttgaagcattaagctttgatgaaattatgcccaggaaacaggcctcttagccactgacagaggtcacaggctcgctggcttacacaaaaccaagctcttggcagagccctgcagggatgggagctgtttggggctaattagcctcattaagaaactgctgatgagctaatggaactgaaatgtggtcaccttctgaagtcacctagcagatttgcagcctaaaaataaagtaactttccagcagtttcccaaggccccaaagcctgtgctcatatttcttctaagaggaagtagtgcaggtgggattctctttccagctgggccagagcctagaacacggaggggcttccagtccagtgaataactctcccctctcttcctgttgcctccagactcagcctccagagctctactcaaatcctgctccctactgggaaatgtatgctctctgtctctgtctttctctccctctgtttctcgatttctctgtctctgtctgcctgttcctctttgtttatccccctctctgtctctccctttgtctctgtctctgtctgtccttgtttgagggtttactctgtgctgagttcccatatacattttctcacttaatcattataagaacctgatgaggctgttactgccattgttcctgtaatgtagatgaggcacagagaggttaaatgacttgtcccaagttccacagcttgcaagttgccagaatttgaacccaagaagtctgactccagaacatgaacctgagcgccgcccccccccccccaggtaatacccccttcaactgtgagttcttagaatgttgtttgcacctacacaatttcccactccaatgcgttcttttcttgtgcatgtacagtgaacctccccaactgacacacagtgggtattcagtcaatgtttgtcggatgactcatggggtataatcttctgaaggcaatgaacttgttttataaacctggggattcccctacccccccccccccgcccgccgattttcctgtacaaagttaagctcctagtttgaacctgttctctctttctatcagatagtctttttattgagaaagttctttctcatgtctagatgaaatctctgacgcacaaacccatttcctgtattctgaatcatatttgaaaatttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatctactcatttagagcacgtcccagaattagtgtgagggttatgttagataatacattgcatctaacttgtacatcagttattattcttaccacaaactggatgcagaagtgtttctttttggtagaataactgagcagtgatttattttggatagcaaatccagtagaaatcttgaggattgttaccccaggtggaactccttagtagaagagctgtagctgattaatttcttcaaagatccatgctccctccctcccttaattcctccctccctccctccctccctccctccctccctccctctctcccttccttcctccctccctccctcccttccttccttccttcctttccttcctcccttccctccctccctccctcccaatatttattgtgcaatgccaggtactagatgctaagtgctggatattcaggtgctagatgctgggtagatgaaaccaaatgaaaaagctccttcccttcatgggagcccacagttaaaaaggaaatagagacaggtgaatccctaaccaccttgaagtaggccaagtgccatggacaggtggaaagagggaaagtcaatattgaacgaccatccactaaaccttggaatcatcactgactcctcagtttctcttatatcttgcagtccatctatctgcaaatcatgccagctttactctcaaatacatcatgaatctgatcatttgtcgtctccccgcagctgctcccttggtccaaatgattaccagctctccccagaactaatttgaatagcctcctaattggctttcctgcttttacattcactcccatccagtctagtctacatccaggggtcaggaagaacttgtaaaaactgaagtcagaacatgtcactcctctgctcagagctcctcagtggcttctcatttcactcagtgtaaaatctgaagtcctcacaaggttctggataatctggtcctggatactctctgctctctaccttccacttatacctgaagactacttaataccaagctactttaatagggcagaaaagcacagagcttagagtcagaagacctaagtttgactcccgattctgttatctattggctgtgacctttggcaattggctctagattcttgagcttcaattttctcatttgtaaaatgggcatactagtatgacctgtggtcacccctttccagcccagcccacacacatcagcctccttgcttggccctgatgacttccagcacacactcacctgagagtttttacagagactttgacaccaatcctggcctagactatcctttctacagatatacacatagatcatccctcactttctttaggcctttgctcatatctcatattaaaaaccccatccttggccaggtgtggtggctcacacctgtaatccaagcagtttgggaggctgaggcaggcagatcacctgaggtcaccacaactagcctggccaacattgaaaactctgtctctactaataatacaaaaattagctgggtgtggtggcgtgtgcctgtaatcccagctactcaggaggctgagacacgagaatagctcgaactgggagggagaggttgcatgagccaggatccaccactgcactccagcctgggtgacagagcaagactttgtctcaaaaaaacaaaacaaaaacaaaaacaaaaacaaaaaaacaaacaaaaaacaaaaaaaccatccttgaccacactcactcattattactacctgcattctcccattattactactctcctgcttaatttttctggacatatataaattgtttaggtgtttactgtccttcactccattagaatggaatctggtttggttcagtatttctagtaactgtaacagtgtctggcacatagtaggtactcaataaatgtaagtaggaagaatgtgtagcatggtgcactagagacacataaaagggggcatctaactggacttggtcatgggtccctcttggaaatctgctctaggttttgaagaattgaaaggtgttaggcaggcagaaaaggagggaagaaggtatttgatggggggtccaaatatcatgtgagaagactcaaacgaatgaaaggtcatgattcatttgtgaaatttttggtgcttctagatggaatgacagccagaatccttctacaatggcctaaggaggagacacagccttactcaactgccctcccccacccacttttgctgcttaataatccactagaggttttatcaacagagagattttaaacatttccccaagccctgccttttctaacctgggcagcgctttatttatttacttattttacttttgttttcctttttgtgttttctctgatttttaacagacatcgaaagtccagatgaagaagagggatctttcctttctttacatgttgctgtgctgaaagccaacagccaggaaaggagttagcgaaatgcccaggcggtcacatcagaacctcagcaaagggccacatggctgggccaggacagatcagcagactccaggaagccacggtgggtgtatgcactcaagtcactgcagttcagagtaaggagcagccctccagttccagccaagggcgacggctttgctggtgtcctctactcgtggttggacgctgctttggaaaggaatcatgttcactttggataccaactgccaaggggctgctttccagttctgcccatcatttttactctcttctgcatatctgggttctcctctgttctctcgggaaggaacaggatgaagcctagttgtgctcactgtagagggagaacagggtggaacttttctgattactccattttccaggtctcagagccagagaccttcatgctcccacagctgaaccagtggatgatgacaactcttaagacttgaacactgtgtctgtgcagttagtgctcttagtggtagaattgttagaactgcccagagttctggagtttcagcttcataggtagcagcatagccatgtctgtgggtcccaacctgtcattccaaacttttctttttctagctagagcaacataaatcatttattaagtaattaggctatgttaggcattgtgacacattagacataactgtctcacttattcctctttataacctttctcaaagcttgtccttctttcttacccctctctgctgccatcactgtcactccaccctggtttatttttcttctaagcatttaccataactaggctacatgatatttcatattatttttactgatcattgctctctcaaactaagatgaaaacatcataacaatagagatgttttgttttgttaacttatattgcctatgcctcaataacataataggtgctcaataaatatttgttggtagatgaatgaacatatgagttaggtttcatggctcttttactgagaaataaaccaaacgtttaaaaaggagataaattacccatggtaacgtattcaggatgtggctgggatcagatctgagccaggatttaagcttgtgccagatgagttcaaagatctcatttaatacatcccttcaggtagtttacactctagcagggccagggattggctggtgtggggaagagaggcacccatctccctgcacaatttcaaaaggcaccaacattcaataatcaaaataaataacattgtaatgtacttaaaataaataacttgcaacgtgcttaaaataacttgtaatgtacttaaaaattcagaagttttaatgccaaaaaccctaggatgaacaaaactttaaaactttaaataaaggcaagatcagtcttattgatttttcccttttgcctcagacttcaatatggctcagaccagcactgatctcatccttgtttaaaacgataacaccctgaccccagccctgcactctaatcatagttatgcgttgaatcttttattctttgggcatttcctccctccaggcctttgggcaactgctcctagactttgggatatcggcctcttgaaatatgtgcacgtttgtgtgttttatctatattcttaaactatggtggactgatcatataccactgtgtgacatctctcactgttgcttcataaattctgacttcctcactttactaagcaatggccatttgcaggcgtggccttggcagcggtgctggctagccgctggttcggtttgttagtaccactgtctatactgcctgctgtttaactttcggatcattttgttgcattttctttattatttagtgatcatgagtggaaaacaaaaatgaaagagctgaatctagcaagaggaagcgtaagtctgccaatctaatctaataggaacaaaaatggaaatcattagccatgtcaaaacaatgctttctcagctcaatcagagcctcgctgcattttcctgttgactgtgtgtccacatgtgtaagaaaagaagaggattaaagaatgcataaaactgctgaaggtatattatcgaaaactgtgtcaaaagctgaagttaaattaggctttgatgcttttttccttcttttttttttaactctgctgggaccatctttgtaacattattaaaattattaatgtagaatatactctttaccaggccctcttctcagcactgctcatgaattaacttatgtaatcccataagaaccctatggggtgtgaaccttgtctgttttatatgtgctgcctattatagatgaaaaagcaggcacagagaggttaagtaacttgcccaaggtcacacagctagtgagcatcagagcacggacttaacccagttagtctgacttcagaattccatcttttgaaccaggaacaccaaacctgttacacaacatgtacatcaactggacttcacatatttcacttttgcacgtttctgttttcaattgcatactcattacatacaaacatagtgtcttgcctatgactctctcccatttttgctcatcctaacctttgccttttctaaggctcagataaaagctacctcttccatgataaaggaaacacaacaaaatgattcgaacgttgcacaacaggcagtatagacggtggctcggacagactgaaccagttgccttccctgatactccaagataggacttctgtatcaatcttagcatgcccatatgcccatagcacttaatttctcaattttctcagcgtactttattgttctttcactctacgcacttataatctgtcttaatacattgtgtgtatttcatctttgcattgtgcaaaatagcaatggtaataactacttgctgaagtgggtacagaggaatggggcctgcccagtagaatggcctttcagctcctgggaggcctgaggtttctgtggattttctatgacctttttatactgcggatggaaattataaagtgctatatacacgtggaagaactgaagtgtactatctactggaaagtgaagcagcaagtgactaatgacaacgtcctttcatggagatgacccttctgggacaccgtcagcaaagttcatcattgacatggtggaaattgcaccaggttggttccgggaaattctgccttcaggttccaacgtgacctttccagctccaacgtgaggaaagcagcttcttcttgtgtaaaatatggataattactcctgctctgtgtacctcacgggctgttgtgacagcaaatgaaagatgatatgaaaggacttcataagctatgaagcaatgaggcagttggaaggtgaccagattttccctgggtggatttaatcatgcttaattcattttccatgcatccttcagagccctgcttgtgtggacattcagagttacccctagctcctgcctccactctttcccacctgtttctcctctgggaggccggcctttagggtcagcagtggctcccttactctcaggctgctagttgggtttggccaatgaggggccctggcaggagactggagtgaggaaggaataagaagccagggtatttattctattgtcctctccctactcagggtctcattggtctggctatgtccctcaactgaggtcactgctgccctcaaggcagccctctctacctagccctctcattcaaatagctaaaggcagtgacagccagtgctggacactgcattctccctgtggtttctctacaccctgcacacacgtttgcaaacagtccctctaccaaactcgcctcaagttctcctaataagtgctatcatttcctactgggaccctcatgattcatctcctcaaggttttactttctttatgaggccttcctagcaaacctggacccagcagacagctactccacctggcactgaactcaaagctctcaccgtttttaccagttttggcaaagtgaataccatggaacattcaatctaatggatagtagtgacataaaaattattttccaatacctttgggagacacaaagttaaacagactatatcactaccacccccttttattttcaatctgcaggacttctcagagcatttcatttgcttttgtgcatactatgcaccactaggagagaaacacgcacacacacacacacacacacatacacacacacatacacacacacacaattaaactgtaagaagcctattataaaatgtatcactaaagatgttaaaatgtgaaaaaatgttggtcttagaattgatggaatatgataacatgtagacattacaagctttcttacttgaggaacactttttggaaagaaaatctcacagaactagagctttagggacatattttggcaaactcttacaccttttactagctaacagcatacacagtgtctatatatttatttcatgattgcattaaagtagctatagatgattaatctcttgctggcaggtaatcgttactagtcccatctttagacatagagttaacacatcctatgggctctgtgagtacttggtggttgaggaggctctgtggcacagactggctagctctttaccaagcctggttctgtttcctcctgtacacaaaatgaactgcatctcccagctttccttaaacttaggtttggccatgggagttctggctaacagaatgtagtcagaaataatgtggaccaccttcaagcctggcccataaaactctcccctttttgttctcttctctcatatgctggcaggatgtcaacacccaggacaaacttggaaaccttgcattgaagatggcagccacttcttcagcctccatctctgaatacatgaacttccactacacccctcttcccattgccactgtttggacttagagtgagcaagaaataaatttctactgtacaaagtcactgagattgtagaattcatctgttactgtgtctggtgttgtacaaactaacacagcctcttgtgactagggagttaggaggtctaagggggtggcctatggctgggcactgcagacagtggttttcgtggaggttatatacagccttggcctcttcaaactcagaacatctatctgcacccagtcttctctctgaagtctcccacatgtcctagctagtctggatattctcttgcccattcttcctgctcctgtgcacataactgtatgcaagcatttgttaaattgctttcatttctctgcatacatgttgatcttcctcctctgaccatgagtttcatggggtcagagaccttaatgtattattgtccctactcttaatgttttatgtggggcttggcattgggtagatactaaaaaaaaaatttactgaatgaacgaattcctaggacttattatagccaaaataaggcatcccaaacttttactttcccacatatttagactacctcccagtaaattccaccattgaaacaaatataaaaactaactcaagacactccaagaggaatcaaagcttcaagaacaacaaacatggaaaacaaaacaatttttatgctcaaactttccagtagggtgctgtcatagctaaatgcattttgttcatggaataaatctttcaaagatttactggtaaacatttatgttgagttgcttcatcttttttgtctttttctcattaataatatgtgaataataaaaatacctcattgatatgaagagttatgttaaaatagtgcatggcacatagccagggctcactaaatgttagctattttcattacatcacaggtgaagagtttcattccgtgattttattaagatgtctggttgttacttaagtcagtaaaccaccccccaaggtcagttccagctcatagcctgtgtttgtatggccctgcaagctgagaatggttgtcatatttttaagggataaaacaaaaaaacaaaggagagcaaaaaaagagcatgcctaaaatatgtactgtttggttgtttacagaaaaacgtttgccaatccttgcctaagggtaacagctcaaagactgcccccatggatgtgtctggaatcctctaagcagcccattgcagcttccctgcagtttcctcctttaatttttaaaatgtttgaaatctttaccaagtccgtagctttggtggctgtaaagattcattatacgtatggattgtccaagctgttacagaaactgaacagtgaggtgctgaggctgtgttccatgggggttcaaaagattacccctgtgacatcttgcaaagacagtgccatgcaaatgaaggcagccatgaggagctacgttgaaaagcttcatgctaatacttaggaaaaggagtcatgagggacgtatgcaattgacaatcagtacagccctctaagcagaaagaccacaaagggaaagagaagggaaagtagcatttacttaggtacctagtatatgccaggcatgtgctagatgccttctttagcatagcagcattttaattctcatacagtccagtgaggtgcttataattatcaccccagtttttcaaacaaggaaactggtttgagcaagttgtttgctcaatcaaggactcattcaaacaggattggagtccaggctaggctgatttataagcccttgttctttcctagaacataaggtgtttcaaactttgttatgaagtttagaagtagcccaacccacagaaagaaaggggtcaatatagacataaatagctcaaaaggccgggcgcggtggctcacgcctgtaatcctagcactatgggagactgaggtaggcagatcacgaggttaagagatcgagaccattctggccaatatggtgaaaccccatctctactaaaaatacaaaaattagccgggtgtgttggcgcatgcctgtcatcccagctacttgggaggctgatgcaggagaatcgcttgaacccgggaggcagaggttgcagtgagctgagattgcgccactgtactccaggctggcaacagagcaagactccatctcaaaaaaaaaaaaaaaaaaaaagaaaaagaaaaaaaagaaaaaagtcaagagagtatttacacataggtgactgagcatgaagagtgcactgggatcccagaaaagtctctgaatgtaggaatggataagattcctgcacagtagaccagggatgcctttttgttctctctctcaatctctttttctctctctctcagatgtacctgatttagaaaaagtattggacttaaaaaaaaaacaaacaatttctgagatccattccagccttacaattctatgcttccatgttttgtagtttctattgtttttattcatgaagagtttatgatcagttgatgccagaaagttgcaactcttgaatgactttaggaattcacctcattaaatggctctgtcacaaccctgagcttgcagggtcagggcccaagtgttccagggatagaaagctggcatttctgcttcagcaaagaggccaacatgcagcctctctgcttacttaacacctgacagaggggagagagagacacgaaacagaatacttgactgacactggcttaaggaatgatgatgtgtttgtgtcatctagtagatatttgccatttgtggctgctccatatcttccccatattttagttaaatctcatattacaagtcctccctgctcaaaaacaggagactagaaaactggtattttcagactccttcacagctagaccacaggcctgaacttgggttctatttttgccattgaaagtaatggcaaaaactgcagttacttttgcaccaacctatatcaatcgaatatacccatgtaagacttggattcatgagtgagcaatgtgagggggtggccatgtgtgggcactcactattctgagattcatcacggaagaggctgctacttcttccaaggagccaagcagagcttccagcattccagcacgtgcagaactggagctgagagcaatagctctgatggtaatgcttgcattgaaacagttcccatggcatggttggacattgttcttgtctctgtagttttaaagcttggctctctctggccctcatggagagtctgcaagtcccctaacatccttttaaattattgttttttaaaatttgaactagccacagtggaagctgtttgcagttcagattcctgactacagtggatgctgttgtttgcaattcagattcttgtcatgtgacaagaagtatggggcaggaataggtgatttcagggttgctgtggtggctcaaagtatcagtaaggattcagcctctatcttcccatgttttgtgagtttactttttatcttaaagttggttgtctaaaggtcactgtcaatgaccaataagactatcaatggctccaagtagcacatcttttcaatttatttttccaagaagaaaaggaaaacaaaaaagaggaaggcatcttcaaaatggattgttccaaggagaaaagaaaaagcagcagcagcagcagcagcagcagcagcagcagcagcagcagcagcagcagcagcagcagcagaaaaagaccttccttccaccttatttttcactgactggacagggttataaggtcaccgctagttgcaaaaggatctgacaaggaagaatgtgatagtcatggttagcttagaccaaccatgctttattacagggggcaaagacattcagattctactattaagaaagaagggagggaaggggttgctagataggcaactgatgcctaccaaaatcccactccaagcttgctccctcgttgacaagatctggcaatgggactccgctcctagaagagggagatttcctagaagattcccattcctgttttccccaggccaacttctaggtgcttcagggccttcagttgaacccattgtcagagagacctgggtttgaatctggctcttccacacccccagtgccacctgggcaagggtttcctcacttctctttcttcatctgtaatgtggggatagcaatagccctgcctcatggattgttgtgaagactgaatgctatagtaacactcaattcctgaacatgataagcaataactattttagaaggaggaggaggaggactagtgtggagtattctgatacatagtccttctagggagggtgactgacaacacatgtatataacccggtaattttagaatagaggtagttgataccatgtgtaaggtgagggtttcctcagacatgtgcttacaggtgtgttgcaaaacaatgttatgtgcatcagcttatttaatctcacataacacctttatacaggtgatgactcaaaggcttaaagatgctcatgatggatctgaaggaagaatctggtaagtgttgggcagaatcactcatccagttatacctgggctctttgcattcaacctcagtacctggaaactgaacaggaatgtcagtagcagattgcctgatgaccatcgaggatttatctggagaaaaaccaggagctttaaggtgattttctttaagtatcagcagcactggcttgtgaagcagcaatttcacatatatgtttagtctccagagattgaagataaggatcacattactggagataaattttgaacaacacaagaaaggacatggggtataagctacgcaacagtgaaatgagtggccttggggagaagtgagtttcctatcactggaggtaatcaagcagcacatcacctatagaggtgatccatgcttcaaatggaggcagggaagtatgggtggaggcttctgaggttcttttcagttctaagatccaaaattctatgagagctacaggcaggtcagcaccagccacacaggagtttctggaatggatggagaggcccttccagctgagaggggtgctgaatttaaagaggccctctggaaccaaacacaggtgtagattcctctgctcttcccttagtgcctctgctgggagaatgacgatgaagtcctccaggtatccaggcttctcccttgagcattagtgagagtagcttgttctgaaaggggagccggctggccattctcactgatggatctcaggaatgtcaccaccctggaggccaggataaaccaatgcatcctgtcctcttgtcaacattctttccctccaacatgacacagattaagagcttattttccaacagcctttgatgcatttttaaacatttaccctcaggattattcctcttgttctcccaacttctagccagctgattaaaattctagctcaattgaaatactctttcaaagtgggccattcagaattaagcaaaaagcactgaacttactagaggtctagcacttttgattaatctttaattaatacttcactttaattttcaatgctacctttaaaacacagagctgtgttcaaaccacaaactcattatcttatcattttgaaaggcaggactgtctgtcagagtataagaaaagggtactgtgtagtagtcttttcctggaagtcagttttgtaaaattttcattgatagacagtagttctgaaatatgtatatatatattagaaagcaaccatcttccaaaagatctaaagaatcagctgggagaaaattatggtaacacagggtaaaataatattgtgctgtgttgacataaattcatctttgttatttatcctgatgattttatctttttattggtgtatcacattgctgaaaatatggtttataatttaatttccactgccaagtacggagaagccactggaggcactgtaatgaggaaagaatagtcatggtacgaccatggaaaaggatgcgaagatgatttatgtaactttcttttcctatttacagtttattaagtcactgtctttttgcaatggccaagtgaaaattaaagcacttcagagaagaacttggggttcagcatcattaggggaagaggaatggatgccttgatgaacttgactatagaaatctatagagcacaacttaatcagccttcaaattgatcttggatgctcaaaagcaggtttaagactgaacaaatctttaatgcatatcctttccctttgaaaagcaacatatgatgcatgcatgagaatgatttagagatttttcccagacttcaattcataaagtaactgcatgtagcactttttgggatttcatgggaaaacaggaaaagaatggacactcttcatggacctgcctccttcctcagattctctgttcatgcccctgaaagacatcatctgtacaatggcaattacttagaagaaagggaagtcgcttgttgtccaaatgatcataataaaatcgagccactaatgttccactttctctttaactgcaggttcagagatgccagcagactccatgctcctgggctggcaaggagctgtgaggatcatgtagcacatgatctcccttccccatgaggagcagaagcttccacatgaggcaggtgacaaagtaataaggctttagtgtcacacaaatgtgactttgaacccatacttctccacttactgtgagtccttgagcacgttgttgaaattagttgagctccagattcctcaactgctaaaaggtgccaattaaacttactttatatggttgtcgagggaattaaagatactcattagtggggactagaggtaatggcaaccatcctagtgtcatgcaaaagcagactttattgggcaaatttatgggcagaggatcagtatgacaattctattcggtcctctgacagacaacggttcccaggagctgagttggccagatatagtgtgaggttgtgctctgggaatgggaccaacccttccctgctactctagctgtatataggaagaatatgagagaattctcaaaaaagcagcaaaagcaatctgaccttgtgccccggctgctcaatggtgttgtagataaacatcttgcaactggacatcagcttctcagggaggtatttattcctagactgatgtcagcccccatttgcaggtagtctaagcccctcccactggaagagttaagagttaaccacagagagcgatacatgctgggtacacaaggtggggcagatgctttcagcagcaggcagcaaggttggcattttagtagaggctatgccttggagtatacggttgagaagagagaccactttcccttgacccatatattttgtgagtcaagatttactttgtggcacttcagcggtggaactgtggcctgctgacaacacagctgtacttcttaaacatcccagctatctatggcttgccactgccattcagcaatcaggctttcctcctctgctacatggtgagttcagtataggcactgaaagcaaactagcagaaggcaaaatgaaattaggtttctaagaaaggcgttgttatctttcgattcaacaaaataaacattcacattgtacctccttggtgccaagaaatggagcaatgggagggggtttaataccagcaacaataattcctaacagttattgagtttgtctgcctccaggcagtgctctaagtactttatgtgttttataaaaaaataacatataacacctgcctttgatttaagtgggaagtcagctacttaaccaacctaataggcagtgctagtgctcagtgccataagagtgtaatagacaaaatgctactgcagcagagaagggttgcaaggaaggtcagagaagatgacatttgagctagaagggtaagaattagccacatagaagaggaatggaaggaagaacatgaataaaggcatgagatggaataaagccatgataatggtgttgatgatgatggtgattaagacccaagggcaaggagaggaaagagaaggaggaacagaaaaaaaaattaaataggatgtaacagatttatactctcagccatcatcaatatacctgtcagtgcaggtttatgtttccatacacacttttcattcatggactgggaagggactgagaagcaaacacaaataggactacaacagtctttgttgacttggccaaaaagcaaggcatcctgtctataggctaaaggttggttctccatttctcactgccattttaggtaaacacactcttaagaaaaactgtcattactcctcttgtgatctttcttccaaagaccccatgaatcctttgtaaatttggtgaggtgctctatgtaaaagcactttgagaaaggtagcaggacccaacgtggaggcaaaggcagtctggtaaagaagtcaggtttctcctttgcagtgagctcacaggatggaggcagccatggccaagctgtctaagggcagaggtaccacagcacaggcacggggcacttgggtaacccaggtctttcccccactcgcctgtggggagcccccacccttccccaccaggtagtaaaggctctgagagaagaaaaagacatgggttcatgcattcgcaaatgcttaacatttgtgaagtgccgaggccaagtgatttggacacctttgttaaggatctctcagtgtatgaggaaaagagacttgtaaaaaaataaccgcatataacatgttgaatgttataaaactgtgatggcacaaaggagggaggcaattgatggggaggggtttgatagggagggtgtgggtacagtaaatactccccaaagaggaatatacttgagtataagagagagaaaggagcttgttatgcgttttaattcttagtgtatatacttacctctttccattggaaggttttacttggcagggcataaggagtaatgaaggagggaaagggggtgtaaggctggggagaaagaaggatgtgggagtgaaatattgtatgagcatttataatgccataagaaacaatatgtatacattgatttgagttcagacaacacacacacacacacacacacacaaacacacatgcacacacatacacacaacttgggaaggtcagtgaaaagattgaggttagtgctatgtaagctccaagccttcaggaagatcctccaaggaagagatcctgaaggcaaaactgagttagcgggcctttgcacagctttcctttgcaagtccggtgtccagaaaatatgaacctcctcttttagcattatcctggtacctgttataaaagtaggaccttcttctaccaattacagtggggatgacgtgagggctgacatttctgaaggtctaccttttggcaaattagatggatggattaagtacataaaatttcatgtgattctcatgaccacattacgatattgggtatgaaaggctagacccatttcactgatgtctggaaattatggcttagagttacgaaataattatctgaaatgacattggtggtacaagtcaggattggaaaccaggcctcctttattccaaagcatttgtctttcccactatgcaatgtttccctgaaagcattagctggaaccactgcttcatcagagagtgccttttgtttgtgcatgatcaaatgtgaaaatgtaaaatattttatatatgccaagtatacctatatgagggattattatagttatttgtcattatttcagtgctactgaaagctttccattatttttaacttttaaattttatttttgagtcaggtccatgggaggctagatatttggagtttcaaatcagttaattacctaataaaaatgcaatataacatctgctcttcaagttaacatttctcctggtcaagggcaaatttggatgatgaaagcatttgtacattctcagactctgaaatccttacagtgatatttatcaccactgatttaaaaattggagggcaagtgtcttgaagccttttatctttccaacgtgtaattaattaccttgtttaaaactcttatgaagtaggtggtgcaggtattatgatcctcatcttacattcttccactaattcattcattttacaaatatacattaacagatttaaaaaatctaagccccagggagatagctgatttacctctaagtcaacagaagaagcaaatgacagactgaaatcaagattcctggctctgcgttctgaatttagggcatttctactaaaccatcttgcctgagtctcagcattaacctatgtcttttgtatatctatccttgatatcttaatgttctggcatatttcatatttctattgtagaaaagatcctgatggaaccagtagcttctaaatcaacacacatttgcctccaaccccccacctccatgaaaatgtggttcttaggactgctgtagcttcagcaatcctgagaaataaatgtatgaagtggcttgtgcactaactcaactacaggggatgggactgctttaattgccatgaggcgctgaatgcagttaacactcagaggaaaagagccttgtttcttggtttctttgaagactgacaattattttatggaacgacttcatgcattatcaaaacttccatagaaattcaatgagacactgcatagtaaagcaagagcccttcccctttacatagcaaatatctctatatacataccctgtacttctcaaacacaaagaagatcgttggaaaacacacagttatgctcaagggagcctgcagattagttctccagcacctcccatgaccctgctcctgcccttctcatctccacttctcctatcaaagattgaatcactcctactcatctaccatcattgtgccctttatagactctatgaataataaagctattttgttttcattttttattttctttcctacaaaatcgtgtgcttaccaccaaagtcagagattgattttgttttattttcatttgtagtcttgatgtctaacacagtacctagcacaaggcaggcactacacaaaatgtttgctggaagagacacaaatgcataaaatcatggtttccatccttagtcaattgcatgttcattgttaagcaaaagaagcaacaggctttgaacatatccagtgcttccctaccatgtgcagaatgttgtgattaagaaggcactaccttggccgggcacggtggctcatgcctgtaatcccagcactttgggagtccaaggtgggcggatcacgaggtcaggagatcgagaccttcctggctaacacggtgaaaccccgtctctacttaaaatacaaaaaaattagccgggcgtggtggcatgagcctgtagtcccagctgctggggaggctgaggcaggagaatggcatgaacctgggaggcggagcttgcagtgagcccagatcgcaccactgcactccagcctgggtgacagagcaacagagcaagactccttctcaaaaaaaaaaaaaaaaaaaaaaaaaaaaaggaactactttgtagaagaggcagttaaaaacagaaatgaagtaaaaaattcattgattgattcctcagatattaggtaagtactcattctgctccaggtatgaactgataactagacatataaagtaatgacaggggaccctggaggggcttatagcttggtagagagattggcctataatcgactaactaaaataaaccaaaatcctaaatggaaagaagactgaaatataaaattagaaaactttggaagagatgcaaatatagctctggcagaggaatccacatgaaaatcaattccaggaatcagcaacacactgctagtcaatgagcaatgggtctctaacatttagataaagtgttactcggtgtcagacattgttgcaagtttcttccttctattgtatcatttattccttacacttacgctagaaagtaaatactcaactccttttacagataaaaactcgggctcatgtgcataaagtaaatagagtatagtgtttaagtatacctgttttggagtctagcataactagatttgaatattgggtccataacttaactgtgtgaccttgaactaatcatgttacgcctcaggattttcacctgggaaagtggataatgatagtgcccacctcactggtgaggcaggtgaagtatttaatacggaccccactaagtgctatttctttagtttgagagcacactgctagcaaggatcaagatagggtttcacactcaggctttaccacagagctcatgctgtttttactgagtttgttgcctttctgggcaaactggataattgacatgcattcattagatatctgatgtggacaaaaaggcagaatgcagtacttctgattgcattatattagggcatttctgtcccaacaatagatttttgtaatgtacttgaactctgaactcaatcccaacctttaatacacacacacacacacacacacacacacacacacacacgtactatagtttcttatatctataataacacagagttggtaggtgatagatagagggagggagaaattaagactctttcctgtgtttttgactctggagagtaggtcttagcttgaggatgggaaggatgatgatttcagttttgaatatattgagtctgagattcccatggatcatacaagtacagaggaaagtacaaatggagaagctatcatctctaggaaactgactatgagcggaaggccaagaagttttgagtatgaaaatacgatatcaaaaccacagtgaaaaaaagtgtggctgtggctacagatatcttaaacaaaacagaccagcattgaaaccaaagcagtaacagaggcagacttcagggagaacaaactcacagtttatcatttaagaaacagaaagcaaaccagagctgagtccctttcatgagacccatgtgcttgctcagaagcagagctgaagtaatattctggaaggctaagtgatgggagtagggagagatggtaacggccttcagttttatcaaccaggtaatcaggatcctgctttcctggagagaaccagtttcttatatgccaagtcccttttgtttacccataagaaagactagctcttttggttccttccattccctttcctacagcagtatgtccagacctcaccctcccacaccacccttaagccttcattcatagttgccatcttcagtccgcatgtcattcacagttgccatcttatgtgactgtgtgtagatacatactgatagttaattttcatagtcccctttcctggtttcatggcctccacacacagctatgacactagtattgtctctaactctggcagcatcttccccagtaaaccagtgtgcaaaagagtgcatcttctttgctagtgacattttactgactggtgctcatggcagtgtttctggtgcacatctggctcctccacaggggaatttccaaggtaagtgtgggaagacaaacctgcaaataaactccaataaataggataaatagcaggatgtatgtacaaggtttcaagagaaattggactagagttcatttcacttcaaagaaaccttggttagtcttcaaaatcaccaagtaaacatgggcagaaactccctccaagcaaagcacacagtatgggttgatttattattttggctactttttcaaaccgctttggcaaaaagagcagaaaacctggacttaaccagcttaaatttatgatttattgtctcccagagcaaggtgtccacaggtcaggaaagctccagggagggtatattaggaccctgactccacttcactgtgaccctgtcttcctttccaagttttgcttcatcagcagttccatgcatcatatccaggcatgccaatgacaagaggaagagaaggggctgtcttttccttctgcctctttttaagaccaaggaactatttcccataaatgctctgacactttctcatttcactggtctgaacaaggtctgtgtgcatagctctaaacccagtcacttataagcagtatgggattcctgtgatagtctgagactatttggaatttgtcccccaagagggatagggtcatgttttctgagagggcctacctgaacaaaatcagtacttcatcaatgaagaagagaaggtcagattttaagtatatagccaacagggtcagctacagttactatctacatataacacttattttttttaaagagaaaaaacaaaaacaatcacaaaggatgctgttagaataggatcaggctcaagaagatacactgattctgggacaaggaactctgcttatggatggcgtgacacaattatagagaaaatctgaagatctaaagaactggctgcctgtgagcaacagctgcagaaatgtaaaaatatatcctgtttatccattaaacactaccgagattgagttgagcactgcaccatgtcagataactctgtgttcactatcagaatgtgtgcagttttagagtgagcagtcattatatgttacatcatgcgcagttttgaaaagtcacggtcactaggtttacttgttggaaacatatccttgtaaaagataaggcatcgttggcatgaaactctctttcacatatacacttacacagagaaatatgtataactgatcatttatttttctttcatattaaaccttttttttttgcttttagtaagagtcatatcaatgaaaatggcaacatttagtctgagaaagttaacagtatatggtatggaacaacacaacctgaccccatatcttcagctggctttcagttttcataaatgaacttctgagagacaactaaaaattcatttctggtgcagaaaaatgtgcagaatgggaactatgcagaatgggttaattccagaagttgaacaaggggaatgcacatatgcaggcttattaagttatgtgcaaatgataagtacagtgaccatctccattgctaaaaattcattgtgaatgtgttgaagttgggattgatggagatactgaagtgatagccaaaattcacccagaaacaagctaaagtgaaggttaaagaaaaacagctgcagaagaaacaaactgtggagacatctccagcagtggaagcaatctgtttttgaagacagcgaggaactccaggcatctagcacattctgaatgggtaaagtcggactggagtgggttgctgtgggaaggagccattctctaaagaaaggtagacagcttctcacggctgggcctctaatgttaggctcagaaaacttactaagttgacaactctctaattacacagcctttgaataaaccgtgacatttataagaaaagacatcctgtcatttatttttgttacactggtttttgccttgcacactggtttaagacttcatgggacttttgaagaacaaattttagacctctgctacagggcaggttaaaatggaatcatccagttgctggttgattttttttcccccacgtgaagtctcccttggaatcaaggtaccagatcttctcttggttatctgaaatgatgtgtgctcatcttcagtgaagaagttcatgactcaaatagatcctagtaatagtgtctaattatatatgccaacctttccctacagcaatatacttcccttcaaagtaattctaatattattactttttttggtattgcattaaagaagatagaaagattttaatgctatctttaggaggatagaagcgtagctgtagaaagaagagaaaaattcagggagttcttattacctggttttcatgattagagtctccacagttgcaaagttttacagaaaagtaaattcacaatagcatgaaaatagtcatcactgaattgaccccttaaaaaatcagtccccattcaaaatcagtctcgacttaccactggaatcttagtcaacatcataactgatctctcaccaatttttataaaatagtcttataaaaatgctctgtaaattgattataaggtaaatttttaaatttcccccagaaatgggagattcatgaagtttaaaaaagtgatgttgaagaactgctggaatcacacgcagaattattgatatgatgatgtgacagaaacattactagatcttatttgaagaagaggaaatttttaaggataatgatagtttaggcttccagaagagaatgccatgaatcccaatagaattagggaatattgataaaatacttgaaatttgtaaaataaccctttttgtgatgttgagaaagtcaaaattaagtaaagaatatgttgtgaaatcatgtaatttttattagaaaaattgtaacaaaagttgaaacatgacaatttatccttcaagaattagtgaatagttatatttattacctgaaatatttttcaaatttaagtaaaatatactaatttttaaataaattttcaatgtaaaatccaagtcaaaatattttcactcatctttaaatgaattttggttttcattttaagataactcacttaaaatagcgttttctaggtatccattgtcattaaataacatggaatgtctgtaaatattcttatctcttttcactgagccatacaacctcacatgagactagaaagtcccagcataacaggtttctggaatggaagtgtaacactgtgcttgaggtagtttcaaaatatgtccacaaaagaggcagagcctaattcccctcttcttgagtgtggcctggacttacgacttagtgctaattaataaaacaaaacagaaatgatggtgggtagagtggattgcatagaaacacccacacccaccgcacaaatttgatgtccatcagaacctcagaatgtgaccttattaagaaatagggtctttgcagatataattagttaagatgaggtcattatggctggccctaatccaatgactggtgctctcagacaaagagatacaccgacagaagacagccatgtgaagatggaggcagatattggaatgatgcatttacaagccaaggaatgccaaggattgatggtggccaccaggaatgaggaagatgcaaggaaggattcctcccctagaaccttcagagggagcacagctctgctgacatcttgattttgaatgtttcacctccagatgtgacagggaatacttttttattgttttaagccaccagtttgtgtcactttgctatggcagccctagaacatcagcacaggagatcacttcaaagactgtgatataaaggcactgcggctttctctgtgctcactctctcttggatctctcactccagtggaagttggctgtcaagtcgtgaagatattctagcagcctgcagagaggccccatggtgaggaactgagccttctgccatggccatgtgagtgagccatcttgaaagtagaccttacttttgtggaaccttgagccagaaccccagtgaagctgcttccaaattcctgatccacagaaactgtgtgaaactaaatattgttttaaaccactgagcattgacgtaatttttatgcatcaataaacaactagtacagtcccctttgttccctcagatccaatttccccaactcaaaagtatactcaaaatgcactcagcattgaacagatccttcttctcctaaggctctgataactttttataactttatttccactccttgtccacctcttttcctgacaggataaaaagtgggcttctttcttgcacagaacgctctgtcatataggcccatcatctctgatatgtgaagattctaaataaagggcgactggcttctgtgaatgagttttattagttttattaccttagatatttcaaacgtgatctgaagtttctcatattcccttgagaaatgctcatggacatgaatgctaacattggcattctacccagtaagctttagaggacattcaagggaattcacatatctatgtgaacagctggtctctggtctccctgatccctcgagagcccagtgagggcagcttgctgctttaacaatttttccagtgaggaagggagaggatacctcaccatggagcagagaaaatggaagcacttacagacataccacaggtctgcaaaggaggcattggccttttgcctgattttacccaaacttatcaagtgcctgccatgcactgggcacaataagttaaaggcccatcattatcaatcaggaaccaccttccaggtgacaactgcatccatccaatgttgaagaaggaaaggtcagagcaggagaggagaagcaaatccatttatacagcagcctcagaactgcaggatcacaccccttgggtgaatagacaagctctgatgactgtctgagtgtggaaaccctgagctggggctgcctatggtcagaaatgccagccaatcttatgtgccccttgttgcacaatgatctaagtgctttacaggtattagccctggaaatcctcataacaatcttaacaggtagcaactgttattatcctcatttcacaagtgaagacactgaggcatagtaagaggcaaagctgagtttaaagctgggcagtctggcttcaggccatgcccctccatattaatctctccatagtcttttgaatgccagcaaaaaggatgttttactctttactacatctgatttggaattttgataaaaatgacatgaggcagaatttcaagccttttaagcaaatcatgcaagtctaatgctgtcgcgcttgctctaccgctgtgggctgatttgtgtctgtgctgggtagatatgttttagaaaagtacatgatgggaggcaggctcagctgttttgcgatcatgccctaaaatggttaggaagccagtggctgacagggatcaatgtagcactgtgaacaagtctaaataaatgttaatgtaatattttgggatgaaattaattaggtgtgctgatagttgcctgatgaggtaggcagatcagtatgatgtggaataatatggacagtttagtgttatataataaacccaaaaccatcctatgacgccctggatgacagctagggaatctctggagctcaacatagattttctttaaatagaggctggtaactaaaagagattctgagtctcacatcagctgcactgcatcagccctctttccttaatctgtggttccaaataattttgtaagtagataaaattctgaacccacccaataataatataaccagacaactaatactgcaatcttccctcttgcagggaaatcgctccagaaggcaaatgaagtagtctcctttttaagcatcctctgcttttctgttaaagtttgtctcattgcaggaatcacagcagcttttgacagcctgggggtggtgaatggacttctggatatttggagaatgccaaaatcctgttatgtctgttattgcagtgtacccttgagtacagtctccccaacttttttcaatatcatggtcacttgggatatgataataacgcatatcatctaattccaaaatgcacttctttgcatgataaaatctcttaagttgggatatatcttacaattgtgagcaccttacaattgctgtcatcttggcagcaggaacatggtacataaaatcatcctgcttcttataatggcaggaatcagtgggatatggtatttgtgcagcatgctggggtaaatgcattaggcttcatctggttggaggcagccttccatgggtctctgtaaccaaagcttctagacagcaccccttggggactgagaagctcaatctctcaggtgcctctgtgattcatctgtaacaactcaggagtgtgtcctgagacttgtctcctcaagtctgagccaccctatctgtgaaacagagatcagaacagcactttccagacgagaccttttggggaccttctgcaactttatgtgcacaaagtacctttcatataatctgacatcaaggaatttcagttactgctattggctttacagagccagggctaggttaaggcaattgaggcattcaccttgggcacaaaatttaagaggtgccaaaatctcagtgattgagataagtaatattttcatgcaatatttttaaaagccaaaatcaatgcaagaaaggatgaaaaaataaaaattttaaacagagacaggatccagctcttcatttggttgatgcatctcattgacttatcctggtcttagtccattcagattctgtcttgaatacttcaaatattgcattaaaatgctatttatcttgattactaagtttttttggtgtccccttaaattttgcacctgaggcttgtgcctcactcctctcacactcatgactctggtgatatttctgatgcatctgatgattgtttctaattgtgcctaaattggtctgatattaactatctgttgactcatatactcattcagcaagcctccaatctgttccaggtgctgtggcaggcaatggagatacacagcactggcctgtggagaatgcacataagcaaacaaacatgtgccatatattctttagggctgtcgtgaatgcatctattcattgattcactccaaaatgttcagcaagcacctcctctgagtgtgcccaatatgagcctgggacaactggagtcacaggaagaaaatagtcactatgtgagtcagtgtttccttacaaaacatttatagtggccggaggcagtcgtgagaaatccttttgaaactaaaaaattgctgtgggcagggcatggtggctcatgcctgcaatcccagtactttgggagggcaaggcaggagaatcacttgagtccaggagttcttgaccagccagggcaaaatcgcgagaccctgtttctaaaataataatacaaatagctagacatggtggtgcatgcctgtggtctcagctactcaggacactgaagcagggggacttcttgagcccaggaggccgaggatgcagtgagctgtgtttgtaccactgcattccagcctgggtgacagaatgagactgactgactgtctatctctgtctctctttatatgtatttatgtatatatgtgtatatttatgtatatatatgtgtgtgtatatatataaatataaaaacttagttttttatatatatacatatatgtatatatatatacatatatgtatatatatatatacatatatgtatatatatatatacatatatgtgtgtgtatatatatatatatatatatatatatatataaaactaagttttttggagtccttttaaatatatgtagttgtagctagctcacatgcatcacctaccacagtgcctagcacataagatacacttaataaaatgtttgttgaatgaccattcaaataaatggcttcctataagtaagatggagatgacaaggttacactatgcccacctagaacccctttgagtgccttggatgctggagggcttggtgcaacggaaagatctgtgatcagtagatctgaacttgaaacctggcttcaccattcattagctgtgacgaccttggtcaatgtatttaatctttctgcaactatttcctttaataaggtcaatactaccaaatgtgcaggtctttagtgagattatagatctgcaaagtgcttcataaagagtctgcctcatagaagaaacttggtggatgtgcatttctttcttttctattttgtttcagaacttgatggaaggaagtacaggtcagaaaggctgagttaaccccaggcaaaaaccactcgggaaatgggcaatgagatatcacagccgctgtcatgccgagggctgtgaccacaccaagaatgagaccactctctttctttgcatgaataccccataagcaagttgaatatgggatgtgaataattcaagtccatttccacaagacagtcacagaaggattggcttcttcaggaaagatgccaaactggggtctttagaactagcttcccgaagacatgcttcaaggacagggaaatacacatgctgtaagcagggaagtcctgaatgctatggcagagatgcaaattggggctgtgtcatgaaaacaaaagttaaaccataaaatgtcactttacatgcagtttaagagagatctatgagaaataaactttagcaaactgctcacatatatcagtgtattacaggtgcctggaaaagcatttctatgaaaatatgcagcatggcatatgtataaatctgtcctgagttttatggtttcatatacagaatcataatgtatataaagtagaggaacacggagatccagtttactgctttaacccatgctagtcaaatggtcttggaataatccaccgaacttacaaagcagcaaacaagtacactcgccacctagaggaaagccagcagcaaaggcaggtctgtctgcaagcattttgtagagtggcaagtgggtggagaacagaatgagatttcttgaccacttgcaaggggtgaggtctctgtaataggtgaggtctctgctaagcacattacattcattctctcacttcagcctccccataactttatgaggcaggtactactgtctccatttcacggatgggaggaccgacaggcaagcgtttgagttacatgtggaagggcacataggcagcagatattgcactgaaatagaagcctcatgaaagcaagggccttgcacaccactgtatcctcagctcttagaacagcgcccaacacttagtaagttcttggtgcatgtgttgagcaagtgagtgaagttggcaaacctggattcagctgactttttgtctggtttcttcccatagaatctttgcagtgatgacaggaatgaagcagcttatttgtgcagaagagtgaattcatgggagtgcagggacagctgcagcctctgagagggcaggttatggagatcctttgggaattcacagtttaaagggcaagctgccccttcttcccagtgcctgccctgaccatttctgcagaccgcgctgccatactaaattatccctgtgctcacatagtagcttctgaggagcaaagctgcctagcatggagtctagaaagaccaagatgcatgggggtggcagacccagttccaagcctcagcactgtcacttattagctatgtgactttggaggtatcacctaaccctatgaaatgagtacattaatgcccatcttaatatcttctaggctggacaagcttcataggctagatagtactcaactccacagcctgtaacctacgatgcaaacggtggcccctgaagttgttcaacacagcggccctgctcctggatgaggacatgggtacagaggagaaagaaggcacaaacagagccagccaaacctgcattcaaacctcagctctgccattctcaagctgtgccatcttgcctcagtttcctcacccataagtgggaataaaagaaatatgtacctcacgggttgttttgaggatgaaattaattaatacatgtaaagcatttggaaggcatgtagcaggtgaatgagaaatattttattgttattttaaatttatgatataattttactatttttaaaattctgtattgaagcaacttattttagggtcttttcctgaacagatttgaagcttctggaagtcaagggttgtatccacttatccacatatcaccctttgtctagtgatgggcaaatacatggtccttgataaatatttgttgaactaatctgaaccatctgttgtcagataaaatccctagtctctttggccatgtttcctcatgaattactttctcctgcttcaaacattgggaaatttgagccaaacacttaacttgttttagttaaaaggtttagatttcactgaacttcagattttgctaaactttccttccccacttttagttccatcttaaatcctcatattttgaaagaaattaggaaaagctctctatgtggctgttagccagaagtccacacataataaagacttctagttgaaagggcttaaaaaaaatctgctgctcttctcctttgggtcatacaattaagtagaagaaatacaaaggcaacaccttccacccaggacccagccagcatcatgcagcctttaaaccttccagggccagtgttagaatcagggcagaagcacccggtttgtcacttgcaacattcatttgtttgcaagacagtatcagggtggatggacactcagtcatgaccacagcccagttccgttcaaagagatttcagctgcaccgagtcagaggcgaggagattgggcttgtctgtgttctccacactataatgataagtggaggtgatcaattgccagagaaactgcagacaaaaaagcccccattaattttctgaaatatttaggaatttgggtaataattcttgagtagttaatatgtgtcacatatagtactattatagtactactaggcacttgcttatatgttaaatttagtcatcatggcagttaaggtaggcatgatgaaccttcagattacagactcagagaggtaaagtaattttcccaaagtcacacagctgaaatttaaatccaggtctgaatctaaatgtcctatgctgagttaaacacttgggctgtggaatcagaaggatctagatgtaaattctaggtctgcctcttaagagctgtattgtttggaggaacctattaaactttaccaatatcatttctaccacatggtaaaatgagaataagaactccactcacagtgttgttgtcaaggttaagtaacatttggcacctgagtctctcagcacaatgtttgccacaaagtaaacaattaatcatgttcagattacttattactactttttaaatttactactcctacatcatgctacttacataattcagatctctcccattctcttaattcttaagagaaaaatggctttagaaatgtttaatttagaaaccctaatttgtctaagctgttttatttaaatgaaaatgcattctatttagaaataggggggctttatcatatgtccttggaaaaactgaaaggagacaagcggatagctaaatagagcttgagtccactgagagacattaaactgaatgctaatatattattatatatttgctaataaattatatttgttgtttaataaaagagagaatatttttaaagtcccaatgatgatatttaactgcataataaaccccacagaaactgctaatcaggagtggggtgattaaatactgcagtgatctaatgctgaaagccttggcattgccacccggtgtccctgatcctcaggctgttctgcataaggctggacaagggctggtctgtggggcatggcctggagcttgtctgctgtccctgtgctggtcaggggccttgctccatgtgcagggagttctgggtaattagaatgtctgtcccagtgattcctttaagcagatatggcctgcccatattgggaatgccccaaaccccaacagaggcacttgcccatgatgttggacttagcccaggtcacctcttggtgcatttactccaatctgtgcttctttctgctcttggttcctcagttcttcagactcgttagctctttctgtccactgtaggatgccctggtgatatggcttggctctgtgtccccacccaaatctcatctcaaattgtaatctccacgtgtcgcgggagggaggtgaatggatcatgggggcggtttcccccatgctgttcttgtaatagtgagttctcatgagatctgatggttttataagtgtttgactgttcctccttcacatgcttgctcttctgctgccttgcgaagaaggtgtctgcttccccttctgccatgattgtaagtttcctaaggcctccccagccatgtggaactgtgagtcaattaaacctctttcctttataaattacccagtctcagggaagttttttatagcagtgtgaaaacgaatgaatacatctggccttggtgacctgttatacaggcatgctttatgactcagtctctgcacctgctctcagatacacttcagatgtttaccttctggtcctacacttggccacggatgagaggcaccttcatctcgccaagattctcagggaatgatcagccagttggcttgctctacggttttctttctccaccttcctcacgagattactctggccaatgagtggtccctggtgagaaactgaggccaagtcaataggttcacagggcaggggtggcagcagcttcacccctgctggacattgttaatgttcagtgaggtcaggcagtctttggtcatacaggagacctaggattaggtctaggcattgggaagcaatggcagagttgtggctgggaaatatttctccagggaagagtgaaatgcatgtccatgcaatttgtaagttaacagcaggcactcaatctcttgactctattactagtggcatgagtagttttcagggactagttttgtgggtagctcccctttagtctgggaacttggatgaagagatgagatggccgaggagtcacttcctaatgaaagcagcatctgaggaaggtgagttctgcacaagtcatcatgccaggactgtggagggtccctggaaggcagaggcatcaagtcttggttcccctttctctctcctagaagagggtatatggtacaaggcactctaaaggcttctggccacgtggcttatgacctaacagaaggaactggagcatattcaaagcttactgtggtgtccacaggggattaagcaaaccagggaataatgtgatcattcatctttccttagcatttggtgtgtgttgggtctgggtcccagtgctttatccagctcagctcgcttaaacctcgcaactaccttatgctctttttaccccaatttcacagaggagaaaatggaggcacagggagattgagtaactggctccaggtaactccagagtcagtgctctgatgctgcccctcttaccatccatttggttctggggaaggttgagtgcaaaacctgataggaagagaggtggaaagagcaccagttttggatttaaatcaccccgggtgtgcctatggctctgtgtctttctgctttgttacactggcaaaattactttactttggttttcttatctataaaatggaggataacgccagcttgaagagttatgaggaagaggtaaaatagttactgtctcccaccaagcccacagtgcctggtccacaatgagcatttgatatatgttggttcttattactatacagaaaagcactttgtaaaatgtgaactataatagacctttaaaactcacaatagcaagattgtaatatgcaccatccttttaagaaataaagttgagaattaaactatcacacaccattgactataagacccatctcaacttcaatgatgctaaatgcaaaatatagtatagtcgacctaggtgcaaaaaactcaaaaagcatttgagatccccttccaccctaactccagcaagaaaggaaagaaatgcaaagaaacaaagacagaaccagtttcttgaggagcacagtgcctgaaccataaagaaaatgaaaagctacacacagatgttcatccaggccagctttctgctggtaggtaatgcatgaaggcaattaggtgctggctcgtctcttcaacattcatggagctgcagagtttaataacgttgaaatctggtgctacctcaaagtaaaaagaggtaatgatgaaagttgcaattaattccttaaatgaattcttaaaatgtcaaaatttgaactacacaagtaatcagtgtacagaaagtggccacaaggtatagaggaggaaagagtgggggacttggagcctgaagacttttgtcatggtctttgctttcctccctaattgccaacaggatctgaactggctgattcacctttggactcaattaccttatctgtcaatggggggctgaaggagcaaacagtaaggctctttcagctctgagcaggcatgcacctgtgccccgcgcaaatgtgcaagccttaagctgaagagggtattaggaaagtgaactttctaatgtttctagcattcccgacctgtcccctggacaatcctgtctctttgctgccagtgctttctatttgcagaaggactgacatgcttgattaaaatgtctcaagcatatccaatcctaatgtattagatctttctttcctcccatgcaatagcagtggcagaaactctgcattgcaaactcatagtttgtttcccgatgttaattctggttatttaaggggtcatccacatgaaaactggtgagggagacatttcagtaaaacaacaacaacaacaacaacaacaacaacaactcccctggtctccaaatgctttacatgagaccacaaggagtctagaaacaatataaaaggacagatagttgtaaagtaagtggccgccaaggagcataaaaataatgacaaggcacgcaaatcacagataaacaagcagaaaatacagagcagtgacaggagtagcataaacaccaaacttctgcacaaaccagcgtttacttatttatttggtccacaacgaggaggaatacagagctgaatatgccacaattcccatttccagttgattctcacattctcatggggcagaaagacagcttcaagatccctttactacaagctgcttgtgcagagtcctaggatggaggtatgatgaaaggttatctggaggtctgaggaaccccaagttgaatcagggggcttatgaaaggctccaaagcgggggaggtcagatggggctcaacaggctgataaaatggttctacatgtagagaaagaaggaattggtattctaaatgactgacataacataaagtccatggttcaggataatagtccagagtgaacggtggctgaattatggattttacagatgtctgtgtgtacatgtgttacaggagacaaacagggaggttgatcttatcttatatgcagtgcagagcaattcatttgttttgaggaggaaagtgataccacaattacataaatcaaggatttaaaacattatcatcatccaaacaaatggaaaccattgttttttatttaccaaagcatatattccatgataatatttagtgccatttacaaagtatctaacatctccaggcattttacaattgtgatgtccttgccaaaaccctcctaaatatgtattattatcccgttttacagatgaggacactgaggttctgagaagtgacataatctgcatatcatggcagagcgaagactagagaaaaggctatccgattcaaaaggctgctttactcccacctgcagtatacgcctaccaccacatgctactgattttggcagccaagagcatgactctgtattttaacaggaaaagccagagatgaaaagtactgtcattagcatagctcctcaaggttactcttaggaatcctaagcaccataccatgcagcactatacaaaaatctggttcagataatgatgctggcccaatttatctgtcatgatacggctgagacacacacggcttcatgcatcaacttactatcgcaacaaactattagcaaaaaactattattgggtttggggaaagagcagcagtcctaatgttctattcccacagccattctcataggaaagggttggaaatagaacagagtctatctttacgatctgaatgacataagagacagtggatgacacaagcacaatattctgctttcataattttatgatttcctgtctagtctgcaggaacaagtaaaacaacaacctctctggttctgtgatagcatctgtccttagaaaacactcatttttagcacagtcagggttgaaattggatgagaaattcaggggtttctccttagcctcagttgttcaatcttcagaggcccactgtctgaaattcaggggaaaaggggctcagtcaacttcatattaactttttcttaatatttataactgtgacatgcaactataactatattattatgtaaattgagaaacggaaaggagagaaatgactcattatatatctctctgggaacttccatcaaaaatgtaaatcatgtaagtttcagaattctaggtgggcacctggaatcttccacttgtagttttctttggagaagattaaaaataaagaaaaccatatgttccactttagtgagcaagagtgaagggacatcggtattaaaagcagaagcaaaataggcagatgagagcttcattttatactgagaaggcatgggtgcaatttacctgcaggccattttcactgggacaacgaggaaaatgtgcccgtgcagagacaaggagtccccacagtctaccccttccaccaattttcagtgttttcctgaacagatttcaagcaacaaaacagtcagctgctgggtaatagctccggttacagctgaaaatgttagtcatttcattatacacactccaaaaggggtatataaaagttgtttacaagggcaaagccgtagttctgaaagctggctttaagagctccttctaccttgccatattttaattctttgaacgtgcaccaacaattacatttttataactgctagcacaggaagttattaaaacacttggctcctatgtgtcttggtccttgcctctgctggaacattgtaaattgttatggctagcacatttgtgcaaacctactgagagaaacatcatatggaaataatttcagtggctagtgaagggtagttaaggacaaccttaacatctaggccatatgatgcagtgattaagaggaaaggtgctagagtcagagggactaagcttgaatcctagatctgcctattaatccctatgggagcaggtcacttagcctatcaaagtctcggtgttcccatttgcaaaatgggaacaataagggtacctccctatataggatgtggtgggaattaaatgagatatacaaagcatctagtaagtgcccaatgttagttaattattaattaattgttagttaataattaacataagctagttaattataattagttaataattaacattaaatgttagttaattgttggggtgatatctttttctcttctacatcagggcagagttcttcaatctgtggcagaatgaaatttcatgaccaaatccatacaagaaagtgttgtaatcactttcttaagagtactgaaagtgaacaatgacaaaactctaccttgtgcctccttcaacaaggggtttcagcccacagcaagattgacactgctgcctggccatgtctgtaagtgagtgacagcaggtaaacaattgtcagcatcccaaactagtatgttaatgtctccccagtggccacgtttgttatcctgttccctcatattggaattacttggctcaggagatctgccaataatatacttttggctgggttttgaaatcaccttgggatacccagtcacacagtgaggctttgtggtacatggttctctgtgccacgtttcacacaggccactgaagggctgtcaatattggcatcaggagagctgagttcaagtcctggatctacctcctattgatgatgtgattttgggcacattatatgaactctgagcctctgtttcctcatataaaaaatgaagaatggggataatattatttatttcacagggtttttgtgaagactaaaagacgtgatgcaaaagggcattgtaaagtataaagagccacatagatgttattataacttttggtaaacaggatcatcattgttggatcagttgcttatattaagaattctgagggtttctgtggctgaagattgccatgatacacataagaataaatgttatatttcttatttaaaggtcagagtggtgagattggataaggataaggtacaatggtgagaggtgagtggctgtttgtacagggctgtgccaggctacagggatgcagaaaaagaagtgtgcaaagacagagcaagatttacttattcctgatttattagaactgaatttctttacatttttcttccttccttacaggcatatcccatttcatccttatgttctttccaaatctcattcctggaaaccctttctcccctagtctcttgagacactttggacttagcactcatgaagcattaatttttaaatggcatatgcttttacaggatccagtgctgaccccatgaaattagccctccctatttagaaccacccaattatgtagagactcaagcacaatgagatctgcaattctctttgcctcataagtcttaaggctttattttcagcattgtcttgttttctttctccaaaacatccaggaaactgaatggctggaagtctgactgcaaaacaatggttaggatagtggccaaatatgtgatgtttctgaatatggaggaggtgggcctgacattccatgctgcagatatgcaagaataactggaggaaagaaccaactggtggggcatagttggcccctgtccacattcacttttcctagacagtcttggaggatggatgctttttccttaagttaggttttctcctccccttaggcttttacctatataacagaaacagacttctaatgatatatttatatatgccagtaacatataatatatagagatgatatagctgtgtattaatagttgctctgctatgtgtctataataaacactacatagcagttattgatttatctctcccactaaaatacctttaggggtattcagaatagacgcccctccagcagccatcttgatacactaagatttggggaagcaaacaaaaatagactgagaatgggacaaagatattacactaagtatttgacttaatcctactccccacaacctgtgggctgtattgcgctgacctcctatgaagccaaggacagaaactgtactctctgaaatcttaacataaaataccttccatgccatttatgaagccactgtccctcagcttcaaatctaactttctgtactttgctttgaggtgctgggactaaggactagcaacctgcgtttctgctttgccagctgatccttgttaggttctgccagtagggggtgctaaaggagactgcgaggccagaggacacgggagagatctgatactcctagtagtgtcagcttagtgtttgcttcaagcaaagtgttgctggcctcgctttttcattctggcagcagcagttcctccctctaacagaaatctaattcagtttgcagtttctccaacgttgcagaaccagcctcattgtggagattttctaaatgcatgagttaaaatggcaaaagtggaaaaataaggatgagagagagagagaaaaaagatgtacatacagcaagtataggattagaaaggcattaggaaaagctttacctgtgaaaaacccctttccccctattatattttaaacctgctgagtttgataaaatgagaactaggtcactattgcagatgtgtgttttttttttttttaatgagatgatttgggtcaactttctatataccaactttatatatagttgtttcaaaggagactcagcatagcaaagagagagcatagtaaaaaattcatgggaaaaaagctgcaatcaatgtagaatgagtctttgaaaattagccaattaatctggctttgctttgtttccctcatgtctagggacttgatttacataaaataaatccagtgtgaacaatgaatacatacacagaaaataagagttgaataaaagattacttatgtatatgactagacacttcaaaggcttatagtgaaagatgaatcaccaaaggctatatctgaaaagaactccagacccatgattttcttaaaatgaactataatggattctgtaaggctagaaagggttcaagacagaactgtaagacttctcatatggtccactatatacaacagccacctgcttgctattgccattaatttctgccttaattctcttacagatagaaccagatacaacagccaccctcttgctaatgccattaatgtttgccttaattttctcacagataaagtcaagaccaattagtggaaaacacacagtggtaaatttcaactccttgaagaaagtttctaatgatctcatctgtatgatgaaggatcagctacctaggaaggtagttaatttgctccaactagtattagtgaagcttaagttggaggactgcttgaatctagaatcagacgggagagtcccttttgcactgagattctcaggattctttagcagccagtaacaagaatatgttacaacagaaattaacagctctattcatttagataagagaggatttgagacagaaccagcctttaactggagtcttttttttttttggcttcaaccttagcaccttctcccacctcaaggtgtgcattatactctagaggagacaggatgccttacagtaatcatatttttcagaggctaagttgctcttcccaaaggaaatacagtgccataatcatgtataagagttctgggttcagaaactatctttgcttggatcgccataacaaaataccatagactgagtggtttaaacaacagaaatttatttctgtacagttatggagtctggaactccaagattatagggtgccattgtggttgagttctggtgagggtgcttttcctctgttcacatggcctttttttttctctgtgtgtttgtgtgtatgtgtatggggcggggacgggggaagttggggagagaagagaacaaactatctgatgtctcttcttaaaagggcactaatcccatcatgagagtcctatcctcacaacctcatctaaccctaattatctaccaaaagccccatatccaaatatcaatactctagacattaaggcttcaatacatgaatgtggaggggaggcacaaatattcactctataacataaaccaaagtgtgaagcaaaggtgtggcaacttactagttggatggctttgggtaaattgtatacaccctctaaatctcatttacttcactggaaaatatgaaccacaataacttctcgatgaggttttggggtactgcataagtcaacaaacagtaagcatgtttcacataaaaaatagtccaagtaaatgtagccactactactgttgttgttatcatcatcgattccgataggacaaggatgaatctggaagttattccatacgctgctctttctgtctccattacctagcccctgccttgctttgctaattagtagttatgcttaaatccagctcaagttttactttgtctagaaggccacctttgattatccccatgagttagatggcacggaccttgctctttcatgacatactaggatgcatttgcatgcaaatagccttaccattgctgggtgaatgtgattttctttctttgattttgctagctagactctgagatacttgaagaaccacctggagttagtcccagcttcacagttaagggcatagttttccacaaactcctctcacttaagatgccagtcacaagtttggaggtctcttgggccactgtcacttttgatgagctggatacaaattcactggtccccacggacaccctcaggtttggtaattcaatagaactcctcccagaactcaggatcatgctatacttgtgattagaatacaaacagggaccaaccaaagtaagagatgcatagaaagaagtctgggaggattctaaatgtgaaactcccaccatcctcaaggatatcttaccctcttagcacatcaatatatgacaatacttataggactgccaaccgggaaagctcacctgagctttggtgtccagagtttttattgaggcttaattgtgtccactgattgactgaatcattggccatgattcactggccatcaataaccagtccctttcctttccccatgggttaatattaggcagctcaaagccccagccttctaatcacacagttggtctttctaatgcagccagctcccatcttgactcaccttattagcataatctatctgggagcccaccatgagtcacctcattagcaaaaactatcaggtgtatgttccaaggggtccaccatggaaaacagagacattcctatcacttgggaaattacaaaagtttagtggttacctcccaggaaccggggaaaaaggaaagccaatttttttttatgacatagggataatgattatgcaccctaagttgcttagtagatcacccaaaacatggtaagtggtccataaatatttgctaaatgaataacagagtgaataataaaagtcaagacaaggccattgttttaaccttatgaaaggagagttggccaattatctttatttttctggatagatttacttctggcatttgaagccctcacatctcttgttctatttccttctctactttctcctattttcattgagttcatcccactatcaccatttcttactactgtgaaacagactttgaatttctacttaaaaccctgcttttgcctttcacaccttttcaatgggattttacagttctgagagctgaggaagtgaaacagaaaacactgtgtaagaaaatcaaattcttctctcagtaacaaaggtgccttgatgcaggacagcatttcaattatggtgttcatttccttccacattaatgtcatttgagttgccactccattacttattattagtcaaatcaataaacaacatgcaggctcacaactcactgcatgtcaaactgaggcgtgcaggtggagctgttaatgcaaactgatatttcaggtgtcaaagggcacattggctcctgagcaaggtttgaggagtgcagtttggttcaacaaacaattattgagtgccttgtatgtgtcagatgttgtgctgggtgccaagaataccagtactaagaaggggcagcatcttcctgaggaacctagtgtcttagggagagtggggatggggacaggcagaatggactttccctctgaggtcctttaattcaaaaaaattcttcagggtctcttcatcaccttctgaagtatgactggtatacatcaaattgcatttattctactgcaccctgacactcctcatctcactttcctgctttatttttctccatggtactcaccaacctctgacacactatgtaatttgcctattggtttatttgcttgtctctcccccagctagaatgtaagctccatgaaggcaagtgtttttgtctagtcattcatagctgcatgtctagttttaaaatctgggtctggaacatggtaggtgttcaataaaaatgtgctgaattaatgaacgaatctactaaacagggggttcctcctgctgcccaaatgtctaagactcctcttgggtagtgaaaaagttgaaaagacatttatagtgcaatgatcctccagagtgggctggacatgttccttaagctgccaggccgcagggcagtgtccatggcctcagggagccggtgggggggaaccaatatgcagtcaaaaccagacaatataatgtgtgttgtctcattcaacccttgatgtatccctgtgagatagaagttattcttccaatttcagaaatgagaagatgggtggtgaaatagcttgcctacagccccacagctcatcagtgctagagctaagctttaaatccatgcctgagagatgccatggttcatgctttcctcatctatgatgttaggctgcctctatatcatatcttagtgaatgtgaaaagtaagcaagatgcatttgctccactagaagcacccacagcctaagctagacaaatattcacagaggaaaccacgttgattctgtaagatgggaccatgcacccctttgcaccattcaaagaaggctgaacagggcagatataaaaatgatgcagtgaatgagctgttggcttccctcatctccctattaactgtgccctggtgacttactcttaagagacatcaaatgaggaaataaatggctattgccaaataaacaaaggcaatgttttaaaagtctctgtcatgtcctgatagttcctgacgatgccactaagcccatttcaactgtcattaatcctagtctgactcattctggttaaggactactgctcccatgtctgagccaacaatgccccaggaaggtactaggttaggaaatattccatcccttgagcaggaagaagactctgaaaatagtatattgtctccatgccttgcttaaaggtggactggagttcacataacagcttctttaagtaaccatgccctctgcactccccctaaacctccttgccactttgtggctatttttcttggcagctagtttttactcctttctttcctgtgctcttctcatctcacttttatcagtgtttccccaaaagcagaccatgcttccagtgactcctcagccatgacagtagatttctctgtatctacagcttaagcaactagctgatgctaagacctctgcctcttaattgcccttgctccttctgcaccctggacatcattgctgaccttcattgaactaacactcaagatacccgctcgactttataattcctggcttctcctttggaggtgacagggcttccttacccttcattataccacttttagggtggttggctagtcaaccactgaatcaatccagatgtcttctaacatagtcacatggtttatgatgttttattttgtaaagcttagcagaaatgtagctccatatagtggttttcaaaccctataaaataatactgaatattttaatgcaagttagataattatcaatataaaaattaaagggaaatttcaaaataatggtaagaacagtttctcagaaatagtctccttaattcagaagttaaaactcagaagtacctggatcacactgagcttatggatccccggtatgaggaatgaacacaatggtttatttctgtttgattggcaatgagattgacatatttctttggctcccctgtgctattaaaaaaaaaagagcctctaaattgagactactgcccatttcagtaagaaatgaggccacatgtcaatagaatataggtaactacacatttataacactgggcagtgatgcagaattgattagcaagtgtaattgcagtaagtaagatgctttctgctcctggtactgatgactcgtggcatattgaaaggaaaaagcatgatgttcaaggaaatgagattctcaatattaagatggggtctaaaagtgcctaaatagaattggaaataacctaagtattgaatgagactgtagagtgtaatggttaagagcatgggctttaggggaagacagatctgaatgcaaatatctgttttaacatgtattagctttgaagtgcagcaagttctttaaattctttaagtctcagtctcctctataatgagacgagatgctcacagtgtttattctctaggtggttgtgagaattaaagcgatgttgcaggtaaagcacagactgcacttgtcacacagccagtgctaaaacagacaaaccaaccaaccccaagcaaaaaactatctatattgttttcatagttcaccagcaattccagttcctggaaggcaaccagtcagtgatctactgaagctaagtcagtctacggatgaggtgcatgtctgtaattgatcagattcagacctagagggaattggtaatctggtcccctcaggacagaatgtggagttctgcctcatgaactcaatctgtaagtatcaggaaaaatcttcccagaatgggaaatgtaaaaagaaagttccaaacatgcctaattatttctaacagattctaaaaacctctcaaaatgaattctgcataaaatgtaaatctaaacagtttgatgatgatccactgtttctacattattcagtctttaaacataaataagcctaggttttctttaaacaattctatcacagagttcaaataaagcaggtgtaacacacacacacacacacacacacacacacacacacacaaagatattctactttagctctctcgtatctggaaatcattcatcttatctgctgctcgctctccctctttctttttaagtaaacattaatccccacagatggtgaaccacggtaatctctgctaccagctgcagagaagaatttttaatgaaatgggaatttaaagggttttacacaaagcaccagaatctattccgctccttctcataatgctcaaattatttttactgccatgggttataaatgcatgtttgtattactgcttctgagagaaactgacctattgcttagaaggtgcttactgctttaagcgtgccgtctcctgcctcacccagtataagggtgtcaagtccccagtaaaaggcactcagtggttaagattacaagatttatcccagaactgaccttattttacactaccaaccctgcccaatctccacctgacttttgttgatatgtctcctgatcttctggcctcccttttaataaactccacagagttgtggctttgatttagctacatctctaactgaaagatttgattcctgtttttttctctccctagtccagcactgctcagactaaccacctggtattctgacatctcctgcttggccttatgaccttcctttacaaataacacttatgagcagctctgttggacaccactcagtgtttatagtcaccagctctcctcgattcttgcccaagagtgttgatatagaacactcatgatcattctcaaatcttttaagaaagaaattcaagttagctatgaagccaaaagtttttttgtttttttttttttacaaaagatgttataaaaggtgacatgcacacacaagtataaaaaatggaaaatcaagataatgtctaatttaagttaagctaattacttttgatgaaaacgtattactttaaaaaagatttatacacctctaaagccgttcaaaatatatcagcatagaaagattttgatgctcataataatttttatatataaattatcaggggggaaaagtcaaactccaatagaaaaaggactattttcacaaattaagggtacacatacaagaagaaaatattaataagattaagaagttcatctctattgatgttatgaaaatttcagccttgaacactaacttatggccacaaatccaatcataaaccatttcaaatggaccaggaaaagaccccaatgtcatggaaagagtagctgcttgaaggtcagaaagcctaagagctggtcttcctggtcctgccatcaactcactttgtgctgggggctgagttgctaggcctcttctagactcagtttcctgacgtgaaagtttactcctgaggcctcccaggtctgtttaatatgggatcaccaggaaacaacataaaacacagcagtaaacttaacaggagtctccctgtcagatccttgaactgatttcacatgaagaacatttagaaggcaggtttcagaaccctggacagagccattttgactcagaatgaggcacggagtgaaagccatttaggctgggtatagtggctcatgcttgtgatcccagaactttgggaggctgaggggagaggatcacttgaggtcaagagcttgagactagcctgggcaatagagcaaaccccctgtctctacaaaaaatagtaatataaaaaagcagtttgtctgccagagtaggaaaaaaatcaaaggacaagaaaatgtctgaatgtcaatttttaggaagactgtcctcaactacccaaagtggtgtttcttactacattatttgtgctcctaaagcactgtataaagatgtctattagaacccatgttaacatccctggcaatatcatgaacttcttaaagcagggcttctcaagttttagtgcttgtccgagtcatcacagccaatcctcagaccttcctgcccaaaccactctttaattagtatttactaaggccaatctattgctgcatgaacttttaggattcaagaatctgacatacagttatgatactctgtcttagcctctccttataaggatgttgacagccagaagaatcacattgaatcaaagccagtgatagaattctgtcaatgactgattatacttatacagttagcagcccctcctaggagattgccctgttgatccaagaatcaccaagagcttttcctgagccatagctttatagggcatgctatgctattttgcccatcatgaaagagctggcagtccacaaataacctgagggcaggatcacactctaaagtgacttgagcaaatgatttgtgtaagctaatgtgaacctcctatggctgtgctgtcatcaaaacactgggtcaaatcaaataagtccatcaaggtgctataaaatatgcatgcaaagagaatggatgtgatgttgttgagaataataaaacagtccataaaagctatgaaataaatcaactgttctttcaggcatggaatacaaaacaccacatacatccatatatattatatatgctgtaagcacacatttattatatatgagcacttattgacatgctagagaaaacaaagtgattaaggtgtttgcttcgtggaagcaatcgccatcaaggaagcattggcacagggactgaaacaatcctttgccctctgatcaatggctttgccaaggataatctcactggtgaacacttcttgtggggaacatgtgtatccctagaaaggatgaattacaaataagaaatacagggggtggtgggattattcttatgccatgactcaggcagctagctctaagatgttctaaagagattcttcgctttcctctaaaaacatgtttttaatatcagatcatggggtgaaaatgtaccctcacccttcagacaaaacattgaatggtagagatttcttctctttttccacccctccctccttccttctttactttcttcccactttacttttttttttttttttttttttttttgagacagagtcttgctctgtcactcagggtggagtggagtggcatgatcttggctcactgcaacctctgcttcctgggttcaagcaattctcctgtctcagcctcctgagtagctgggactacaggtgtgcccaaccatgcctggcttgcttatttatttatttatttatttaagatggagtttcgctcttgttgcccaggctggagtgcaatggcatgatctcagctcactgcaaccttcgcctcccaggttcaagcgattctcctgcctcagcctcccgaatagctgggattacaggtgcccaccaccaggcctaatttttttttttttttttttttttttagtagagacggggcttcaccatgttggccaggctggtcacgaactcctgacctcaggtgatccacctgccttggcctcccaaagtgttgggattacagatgtgagccatcgcgcccagccacacctgggtaatttttgtatttttagttgagatggggttacgccatgttggtcagcctggtcttgaactcctgacctcaggtgatccacctgcctcagcctcccaaagtgctgggattacaggtgtgagccaccatgccagcccttccttcttctttaaactttttttttttgagtgtactttaataccagttgcttctctacttgctatataagcaatgtcagcattacttactgagcatgtgtatgcgacagcccttttctatgtaccagagggtcagaaccacagacacaaatgaactaccaccactaccctgagagagttcatcatgtaccttcaaagactcatgtgtaggcaactaatgcaaatgccaagaagaatgaaacatgtaccttaaaagataatataaccaaaggaagaattactaatcccaactgcagagattttgggaaagggtcccagtgtcctgtacaagatggcatttgaattttgactgaggaataggattttttttattggtaaagaaatgggaaaagcatacccaggtaagaaacagcacgttaaagacagagagcagaaaggcagtggctacacttggtcttttctatggagaatttctgcagtgcctgtgctcccataagtctctggctagaatggaaatacatttccttccttttgatagcacaaagaatagggtttattccacagagtgacttggaaccttagtcatagtgttttttcagctttattactcacctacctgtgataagggcctctcccagcaaagtgtcttgaatcactaaaagtttgtctctccttcgtagggctcatagttgacacaggggccagagaccaagcaagttcaagagtagcaccccaaaccattgtttcttcagaaattatcagccccatcccaccagatttatgacaaacctacggtgttcttcccccttcagagacctctttgtatctctctgctatctgccttctgtcaagagatttccagtgtttagacatctcaatacatgtcagaactccaaatgtagaaaggattcaagtctccttgtaagggtatactaggtcctgaacaaatagagaccatttacagagctgtctggagctggctcatactagcttgcaagagccaattgttaaattttcaggaattttgcaaactggttaataccatattggtagcttgaaattggccatggttggagaatttatatcacagagactggtaaaggctacaaattaggactcttatttccagggagcttattgttaggttcttgccagtactgcaccaagtatgtaactctaaatagccctcaaaccttccacaccagttagccaaaagcacctaagtggctttcagaggattaccatcttactccatatgcatggaatgttggtgtctcagggagtgttgagagatatatatcaacaatggtgctgatcaaacacccactgtcaagagttcaatgtgctgtaggagaagaagagaagtgctggagtttagtttctaagcatgctggctctaatctttactaactgtgggatttgagggaagttatttaagtctctgcattgttttttttccctcacctgcaaagtggggaccataatacttatgtaacagcgttaaagattaaataaaataatatttgaaggtacttagaacaaggtacagaacagagtaagtacccaataaatgatgacaatgaggatagacaactaggttcaaatgctggcactgctacttttcagtttgtaccatcttgttaaacttatttcacttctctgagcctcggtatttttcctataaagaattggaaaaacataaactccttcacagagtgcagtgcattaggtagttggcactcagcaatcgttctatcatcctgatctcagtattacaggacctgggaggcaaaaaactacatctcccacactcccttggagctagcattcataagcaaattaggttccaccaatacaacgtacttgtttgaaatgtagatgcaagagagaggccaattttttgctttttggctttctttattggcaagcatggctgtggagatgttgggcttcactgcagcacaattctagtgtccatgactggccatgggtgtgctgagaggcaattgtgctggctggggtgggcctttggttctgctccttttgactgtggcagtagaagcagctctcctggtttccacagtgttgttctgggagtcactctgagtgtccagcctagtgtttttcttcagcccacccaatgatgtaaatacacatttcactgcctaaaatgaccaaaaacgtgtttgtgttctgcaactagaccctgattgataagcagtgtttgggaggattacacaagcacataggatagtgcaccagacctgcaacacttactattgtgcctggcttctattgtgtgttcttaataaatctgagttccttttcttcccagacttgtcaaccctcctttgtcaatggaagaaaaagacccagttaactatggcttttaatcagcatgacttgttttatgaacttcctgtgtagagtgtaggggaaatgtatatatttgcttcctgaagaatccagaccaatgctctaagtccatttttgtacatataaatacttgaaggataccaaacaatattacaagactgtggctttcatggccaggactatgtggtatattttccttgagagttaagaatcaggtttgggttcatttatgcccattcttagtggaggttttgtccaacccctaatatcatcttattaattccattaaaaatttctcatctgagcatctactcttggagtaattattaaaaaaaaaaaaaaaaaacaaaaactgaaaactcagctctcctttatctgctcttttattcaagtcattttcaaatttgtttcccaggcaatagtaattgtttcagtaattaaaatgtcaggaggcgggcagagttgattagaatagcctctgaccacatgcaccaggaaaggcatatgagagagcaccaggtgacctcattattaacgtggtctattatattaaccttgttacacatgtaaaatgtactgaaaacattgatactcagctcttccttgttttgtttctgatacctcaagcaatagcccactattagaattaaccactgcaagattattacaaaatgaaggacagaaaaatgaaatgtagatatgagttgaaataactctaacaccaaattcagcatctatttctattactcatatagagtgtctgttttacccaaggctattgcaacttaaactgggtctttcctcctgttgacatgtctccacgcttacccttgggcatcctgtatagggtagggtgaggggtagtgagtaaggaagatgtttttcttctgtttttttttcttttttttcttttcttttcttttcttttcttttcttttcttagggtctttctttgttgcccaggctggagtggtttgatcatggttcactgcaggcttgacctcctgggctcaagccatcctcccacctcaacctcccaagtagctgggactacaggtgtaagacaccacccccagctaatttctaaatgttttttagagatagggtctccctatatttcccaggaaccaggagagctgcttatactcttatactgcccaagttagtcttgaactcctgggttcaagcaatcctcccatactggccttccaaagtgctgggattatgggtatgaggcactgtgcccagcctagaaaggcagttttgacctggatctagatctgtgttcctagactgatggagaaccatggtattattagaaggttaccaagtcaccgtgatacacttaacactttcaagagtcaacacaatggaacgacaaatacttttgaacttaaaagtcatttaagctctgtttacagctcacagtccttcttcatgtggaggcagctttatgcaatggggaagaaggctgtttctgcagtcattctaatctgggttctattctttatactgcaccccaatctctgggacagagacaagtctctcagccctgttcttttgtgtttttacttatttttaattttttcaacttaaaaagttatttatattactaaagtttattttttggggggggtatatagttaaatgagttttagtacatgtggattattgtagccactgccaaaatcaggatacagaacaattccaacacccccaacatttccctcaagcagtttcttttaacttaactccccttcaccaccctctgacacttcttactcctggagaccgctgattgttatctattcctatttcttttttccagaatgttctataaatggaataatataaaactttttggagtcagtttccttgacttagcacaatgcctttgagattcatatatgctattgcatttatcaatagttcatttctttttattgctgagtagtatcccattgcatggggaccatggtttatctgtttaactatggaaagacatgagagttgtctccagttgtcagtgatatagataatgcagctataaacattcatgtgtaggttttatgtgaagataaaattttatttcttctctcgtttttttttttttttttttttttttgaacaaggtctcaccctgtcacccaggctggagtacagtggcatgatctcagctcactgcagcctggacctctcaggctcaagcaatcctcccacctcggcctcttgagtagctgggactacaggtgcatgccaccacacccagctacttttttttcatctttttttttttttttttggtagagatgaggtctctctatgttgcccaggctggtctcaaactcctgagctcaagtgatcctcctgccttggcctctcagagtgctgggattacagcatgagtcagtgcacctggcagtttttatttctttagtgcaaaatgtctccaccttgaatttaaagtggaataaccctttgttgtggggaatgtcctgtgcattgcaggatgtttggcagcatccttggatctatccattaggtacccgtaacagcctctgaaccagttgtgaaaaccaaaatgtctcctcacattaccaaatgttggggggcaaaattgacttcagtgaagacttcagtgaagaattcagtgacttactgaagacttcagtaaaaactcataagcaagatcctggtccatatggtagtatatgtttcactttaaatgaagctgccaagctatttttcagggcatctgtaccattttgcattcccccagctatgcctgagagctccaattgttctgtatctttgtgagtacttgatattagcaggtttcttaaattttttgccattctgtaattagggagtcccttgattttaaaatcaggaacgacaccgtggcaaatattagtgcatgcagctcactaatatttctagttctgaaattctcctcacttgagaaagtttcatttcctgctccttttaggttgcatgtgactatatgaattggcttggctagagtgaaagtggggtgggtcacttcatggtggacatgtgtaggagctgttgcacactgctccatcttccctcccccaagctttagcaaccacctacagtccagatggtggagatgtcatcagccaatgttgctgagtagaaatgacatggaagagagtaccctgccaaacctcaaatggacatgaggtatgtgtgagaaataaaactttgtttaaatccactggtattttgagattgtttgctagcttattttgactaaatcaaattactatgtgatagactcattgtgagcatttatgtgacaaatgtgggtaatgcatttaacacaattcttggctcaaaaggagttcagagtgaatgattgctactattataactatttactcttccctgaccatcccgcatcatgatgattctctctttgataaactcacagcttttactctctgtaatgcattagcagaactactttagcttcttcaatgcaccttggcaataaatcaaattcaaagatatgaagttaagtacccatttcattgaccacctgatcatcaggtgtgctggtacaccatctaaggttcaagggggtagcatcactgtattggtgcaaacatctctaaatgacaattagtattactaagtcattttaaaacctgtcttctataggtcagtgtatagaaggtctttcattaaccagcaactttttcacattttttgtctatttgtccatttcctaagaatataaagagaggtaaagaggtataaaaacacagtgattctcggctgggtgtggtgactcacacctgtaatcccagcactttgggaggccgaggcagacggatcacaaggtcaggagattgagaccatcctggctaacatggtgaaaccccaactctactaaaaatacaaaaaattagccaggcatggtggcacacgtatgtagtcccagctactcgggaggctgaggcaggagaattgcttgaacccagaaggcggaggttacagtgagccaagatcgcaccactgcactccagcctgggtgacagagcatgactccgtctcaaaaaaaaaaaaaaaaaaaaaaaagaaaaaggaaaaaagaaaaaaacacaatgattcacaaagctgatagtgcatcagaattacctccagaaagttgggaattctggttctaagatttaaccacactgaggcctaagacttaacatattttttaaagttctccatataattctgataagtagacaagttcagaagcccctgcattagttgtagaaatgtaggaagtatgaccctaagaaacttggcaagacgcagaaaaactcctgcaattaccccagctatttagagatgtgaagagtttctattacctacctggcagaatcacaatctgtcataggatatttttcacattattgttcaagattgaaatgtatccctggctctgatctaactggcagacagacctgaggaagagaactcaactctgtaggcaccagggttcatatctgcaaattgtgtgagttgggcttccacctataaaaatctttgatccattatcttctgtgatccaggtattcattttaattactcaatcagattattgcatgtattgaggaatcttctacattttccaggattttaatacataatatgagccaaagaaatgtttttcaagcttataactattcattcactgacaaacagggtgctcttccaaggaactctttttcaattttttcatgttcatatatatatatatatatatatatatatatatatatatatatatatatatatatatatatatgggtgtgtgtgtgtgtgtgtgtatgtgtgtatgtgtgtttgtgtatatatatatataatgaacaaatataacaataaaattctataattcccaaatctcaaaataaccacttttggcattttagattattgttttcatttttaaataaaaacatatactatataactttgtgactttcctttttattttccattataacatgagaatttccccatgattcaatttattcaaaatggaacttaaacaactgaatagtttcttatcagttggttatcacacttgtgtagccatttatctactgtcagatatttcaggtggtttctaattattgtccactgaacatggtgttacagtgaattttttcatgtgtagctctatttctttaggataaactaccagaattggaattactggggagacaaatactacaaatagctgcataagcctttaaaatgtcctattttaattattttcttcttctactcatctttcttactgctcccaagattatctatctaacccagagattctactctctattctacttcattaaatctactatgggatccccattcaagacagtggagctgagcacacttatttgataactccagacttctcaatattattaagatgaacaaaaaggtctaaaataaagacctacatcaacgaaaactctagaaaacaggagtagatagaaacgttgagaaacttctgaatgataaagagcaagtaagataggcttggctgaagtgaggaccagagaacagagtgtcccaaagctgaccaatgaaaagctcactgcagagaggtcattgctcccaacagaatcctggagaaactgtgagcatgaggagcagaaatgaaatgcaaaaagtcccctattaaattcttcttatccacattagggaggagaattcttctaaaaagaaaaggaagtgacatgtgtccgtgagtgaacttcactgaccaatggcactccttgagtgaaggtgtattaatcatgtcttctattttctgtatgctttgatatctggggcctaggtgactcaggaggaagtgcccctccaagggttagccaattcctagacataatgaacaatttgcctctaagcatgcctttcatatgcaaactggccaatccagaatccacacctcaactatcttctttatagggctctcatactccaggccactaaccacctgctctaatcaccccagagcctgctgaaactaataagccagtcctaaccctgctttccttgccttacctcttccagcagaaaccgtaataaggctcttccccatagttccctcctccctttattcctcctgaccaaccctggtatgtccccgtgtggtactgagtagattggcatgccccttcctcttgggaactgtcagcaaaaaaatatttttttttctttttttttgaggcagggtcttgctctgtcacccaggctggagtgcagtggcatgatcttgcctcactgcaaccccatttccagggctcaagtgatccttcctcctcagcctaacaagtagatgggacggcatgtgccaatgcacccagctaatttttgtatcttttgtagagatggtgtcttgccatgttgcccaggcttgtcttgaactcctgggctcaagcgatcctcctgcctcagcctttcaaagtgctgggagtataggtgtgagacattgtgccctgccacaaaatgtcttttccgtggcaattattttctaatctgttgggctcactgcacctcacatttttaataccttcccaacttaactgttgactccctgccaatctcctataggaaatcttatttattggcatatctggtaagtttcagtaataaaaaaaaataagtaatgaaagacttacgtggaagcatgaaaaaaaccaatgttcatagtgcattgatagatgaagaaagaaactaaaagagggagcacagaacttatttctacaaatatatgtagaaatgtagttgtatttcaaattagtggtgattagacaatttatttaatatattgagtaattagaaaaaagttttatcggccgggcgcgggtggctcacgcctgtaatcccagcactttgggaggccgagacaggcggatcatgaggtcaggagatcgagaccatcctggctaatacggtgaaaccctgtctctactaaaaattaaaaaaaaaattagccaggcatggtggctggcgcctgtagtcccagctactcgggaggctgaggcagaagaatggcgtgaacctgggaggcggagcttgaaatgagccgagatcacgccactgcactccagcctgggcgacagagcgagactccgtctcaagaaaaaaaaaaaaaaaaaaagttttatccttttatcatacaatgaactcaaaataattttgagatagattacggatataaaaaaccataatgattaaattaatagcataatgtttttataatcttatgctaaagaaggatttatcaataaaggacgaaacccaggattcacaaagattcatgtattttgtattttaaaaatggaagctttggtacaccagcaaaagtcactataaacacattcaaaagacaaatgataaaaaagaaaaaatttgcaacacctaaaacataagaatggttaatattcataaagtataaaaacataaaaatcaatataaaaaagacagcctatctgatagaaaaaaagaacggggatatgtataggcaatttacaaacaaatacaaaaggcaaacatatgaaaaggtgatgaacctcactaacaaggagacacaaattcagtcaataatgagagggcatttttcccatattaagttgtcaaaaattataaagactggtaatatccaggtttggcaaagctgtgtgggaggtgggtaggaacggaacatctttcactgttaatgacaggagaacagctttggagaagacaaataggcagaacccatctaaactacaagttagtgagtttttggtttggcaatttcacttctaggcacatatcctattggaatgcttgctcacatgcataaagacacatgcgcaaaatgttagaagctatatgatttgtaatagtaaaaaagtggaggaatgctaatggttcatcaatagcccacagttgaatattgtggaaaacttcgcagtggcaacaaaaaaaaaaaaaaagaaaagaaaagaatagagttacacggcctgactttaaaatagatgcgtatgttatgctgttggctaaaaagaaagaaaagttgcaaaatgatataacatgtacagtattcgctatgtatatatgtgtttataaaaatattttataaaagatagctatttatatatacaaaatataagtaattgatgaaaaactgtttcataaaattatcgtgttatattatcatatcctttttcatttttcccagttaatcatttgaattcccataagccttagtacaagaaaatccaggatctcccacttgagattgcctatccccagaattgtcccaaaacctcagcacctcattaatgccaattgtaaattgtgtgtgtgtatgggtgttgggggaggatggcaatccatcttccagattcaaaagatggaactaaatggggctggctttctccaggtatcacctgactacatcgacctggcatagtcaagtctatgatggtaacacttgactgtgataatgccgcctgatttaggatgtcaagtacttggtactcatagggtgatgctccctatggcttttgggctgagttcagctgtgagtgtggctctctgtgctcagctctcttgttcctacacaaacaacttcacgggtctctgccagccagagcaccgagtcaagactggaatttgtcagcttacagacctaaccttgccatcctccttccctctctagggagcctacaaagaggtccaggaaggttttctttttaaaatgtcagaagttgctatttgttctcctttctcagaatagagtaatagtttggcacttctctcttgaaaaaagttgtgctcccaacagatataatcctggctgggtacatcttgggtaaggtactggtggaaaattttgtttgtatgatagattttatgtgtacagtgcaggtctagaagaattcacactaaactattagtggtgggtcatctccttttgggaaggcaggaagtaatgggagtgaaactaagtaactactgtcagtcacatttactccttagcactttggagtaaactgtggtttgattttattttgacagggttaacaaacttggacatacacacacatacataaacactcatgcaaatcaacttaaaaataatacaataaattttctttctctcttctaatttttcgttttctgttggatcattcttctctgtgtatactcaatgttctgttattcttcccaacttaaaaaaaatcccctcctgatcactcttcccacttgtgcttttattactccatttctttgagctttttacattaaaagtcctcaagagttatccatattcatttgtaaatcctttcctcccattttctcatgaatatatgctaatgatcccccatcccactcacttctactgctcttgttaaggccactaatgaatggcctccaagttgttgactccgtggtcattttcagtctttaccatacttgacccatgaacagctccttctgcctgagaaccctttcttctttcatcttccaggataccacactcttccagtttcccagctccctccctggcagctccatcttaagttcccttcctgattccacctcagctcctccccatcttaatgttaggtgctccagggctcagtccttaagccttttgtctaacatgatttcattagccatggctttaaatatcatctatgttaaatacacctcaaaatttttcttttagcttaaccctgtccaggattctaggtttatacactctacctcctatttggggtctccacttggatgtttgacaaatatgtcaaacttggcatactcaaaactggctcatctcatggtattctctcccaaatctgcttttcttatatttttctgcaaaatgataaaggataacttcaatcccttcatgctcaagagaaacccttgtagtcatccttgacccttcttttttctttgcattccatatttaacctatcagcaaaatttgttgactctaccttcaaattatatccagattctgaatacttctcactagctcttctgttgcctccttgggtcaagacacagccaccctttccctggattgttgtaatggccttttcactggacacctggactcagtctttgagaaccttcagtaattttcaacacagagtgatgctgtaaaactctaaaacagatggccactttgctcgcagccctacataagttcctcattgtactcaaattgaaagcaaaatccttgcaatccctctcacctcattgccctctactcctccactctccctctccagcctccaagctttctctagaacgggttgtcttgagatctttgcatctgctcttctccctgcttgggctattctcccctgcaaacacccaatggcttgcaaatttaactcatccaggtctttgactttatgttctattctcattgaggctttccatgactatggtatttaaaatagcacacagcttctcctaccctctctgtatttccgaaccttttcagcattttcttcttcatagcacttagtacaaaatgattagtgtcctagtgctgtgttacaaattagcacaaactgggaggcttagcgcaaactgggaggcttagcacgacagaaaagtattgccccatgaactgtgaaatcaaggtgctggcatggttggttctttctggaggttctgagggagaatctgtgctgtgcctctgtcctagcttatggtagtcaccagcaatcctaggagttcctttgtttgtagacacatcattccaatccctttcctccatcatcacctggctttcttccttatttgtctgtattcttgtatcttcacatgccctttctctatgaggatatcagtcattgaaattagtgcccaccctaatccagtatgacctcatcttagttcgactgtatctgcagactatttccaaatgaaatcacattcacaagtatcagggattaggggttcaacatatattattgggagagacaattcaacccctagcaccatatgacatacaacatatttttacttcattttttgtctttctctttatacaagaatgcaagctctaagaaagcccagagttttgtctgatttttttttcactgctatacctgggtgggatgcaacccataaagacttgttgaatgactaaatccctctgctagctcctcatgaccaagaggacgaaggtccaaacaatggatacagcattcatgctgttagacaaactgggcctcactgaagttttcacccttagctttcatcacttccctcagtatctcctgtttctactaaggtgaactcctggatcttactcaaacacgttcacaactctccttatttgctctttctctccccttcacccccatctactcctcttttcctctacaacacatatttctctgttaaaatcttacacattctcctaagaccagctcagttctcactctgaaaccttccatatgaacagttaacaacctctttttctgggtccctttcagttagttattatttttctcactagaaattttatcatcttagcacatgagtgcattggtgtagaatcatgacaacacaaatcttctccattcaactgggagatctttcagacaggggccaatgccttccttatctcttcatttttccttcagtccaacccccagcatctatccagtgcttggactgtaacagctgcatgctaaacacctgttgaccaaatgaaagaagtagggtagatttgccttcttaagctttgaagtaacagcaaatataattttggccactgggccccaggatatatgtactacatagttagccaataagtaggtgggaaagatgaggtttctaactaaggcattttggaagttacaataaacaaaagccttcgagaaaaggccttagtcatggtcagagagtgcagagagattagcaaaggagaacacaaaatagactactcaggaggacaaaaaactggacttaagctgtctaatagctaatgcccatccagtaagtgaagggcagaatcctcccacagccacctgcattattttctaaagaccatcccttagagctgtttttagaggtattttgagcattgtgggtgaatgtggcagtgtagtcttagatatagatgagaaggagtggctataaaaactgcaccttccaactataaaaacttcctggagtaacaattccctcccacaatgtaattgaaaagtgcaattgatcttatctttaaagagtgttctacaaaatcttagagtcattctgttagaataacttgaatgcttttaaaaaacctaattcctgggtctcatctaagatgccctggaatcagatctttgcagtagtgtactagaatttgcactggcaataagctcccaggaaaatatgagaatactaatatttaaggattcctacattaaggaaatccatccctaaatccatgtatatgatttatcatggtcagccattgtgttggttaattttatgtgtcaacatgactgcactaacggatgcccagataacaggtaaaacattatttttgggtgtctgtgtaggtgtttctggaagagattagcatttgaatcagtagaactagtaaagaatattgtcctcacagaatgggccagaattatccaatctgttgaaagctcaaatagaacaaaaaggcaaaggaagagtgaatttgttctctgtttgagcttggatatccatcttctctcaccctgggattttggtacttcttgttcttgggccttcaaactagaacctggacttatgccattagctccccgtgtgcaccctgctccattctcacgccttacttatgccatcagctccccctgtgcaccctgctctattctcatgcctttggacttgggactgaatcacaccactgtctttccaggttctccagcttgcatatagcagataatgaaaattcttggcatccctaataatgtaaaccaattcctataataaacctcctcatatatatatcctataagtctgtttcagtagagaacttcggctaatacaatcttattcttgaaaatctggaaaggaaaaaaatgaaaaaaaaaaacccacaagtctttgtatagatttgtcttcaagttagggtcttcttaaataccccctccaatagaactgctcttaaagaatagacacgcagaaagaagcctctaggctgaggcaagcaggcccacaaggctgaaacacagaatggaggagagcagcagttcttgagagcttgttagcaatcaaacctgaaggcaggcggggactctgagatgagtagaaactctgggcagccattcagtatacttttcagcaacccagaactaaatgtaggcttcagatacagagttatattatgggaacagcaaagtctttggactaacaaataacatggttgggatccttgctctgccaattacttttggttcagcgaatctgggtaagttatttacctcagcctcagtttccacatctgcacaatgcgaacaacatcaccacttggctggcttattgtgaagataaaataaaataaaagtgtgtgttggctgggcgcagtggctcacacttgtaaccccagcactttgggaggctagcttgtaatcccagcactttgggaggccaaggcaggtggatcatgaggtcagcagttcaagaccagcctggccaagatggtgaaacccctaaaccccttctctactaaaaatacaaaaaaaaaaagaaaaaaaaaaaagaaaaaaaattagtcgggtgtggtggcaggtgcctgtaatcccagctactcagtaggctgaggcaaagaattgcttgaacccaggaggcagaggttgcagtaagccgagattgcgccactgcactccagtctgggagacagaatgagactccatctcaagaaaacaaaaacaaaaacaaaacaaaacaaaaaaaactgtgtgtgatcacttcacatgatagttgaaacttggtaagtccctgaaatatgacatcttctagatttcttttccttgtctccagtaagagataatcagaaggtggtattgatttttaaaaaaaaggagaagaaaggaaagaaggaagggagagaggaagtaacaaaaggaggaaggaaaaagaaatagaaaaaaagaaaagatacacaaatagaagaaaattagcttggttcagagttttccagacaaaataagctactttcaaatatcatcttttactgaacatttacattaaaatctttaagcggtacaccatgccattgtagatttctccaaactaaataaaaatggtaactaaatagtagaataaggattactttctatagctgagaatgaaataatttgaaggtaaacattggaaagctcttaaagcatcctaaattgtcttttcttccttcaaatgtcaaaatacctatctcaatagatatttttaaattgcattcctctttcaagatccttctatcccttgtgtctcttgcttaggaatgaaataaataacttagttggaaatgacataatctctggtaggatgggagaggagtttaaataaattccaatttgaccgtcttctagatcttggtagatactgataatgctttgccactgagatttgtggaaactggagagaaaaataatctttgtagtgtgttctgctgttcccattacctattgctacataataaatcatcttcaaaattcagtggcttaaaatagttatttattattataactcatggttccatggattgactgggatcagctgggtgactctcacttggggatctttaatatggttgtcgtctggagatacattatgtgaaggttctctgggatggctgtctaagatggctcactttcaaggctgacagttgctcttagaagttggccgggagctcagctggtgctgccaatcagaataacaacacatggcctctctaggctttgtcttcttgggcatggtggctgaattctgtgagggagagtcccacaagtgggcatttcaagagacccaggtggagattgcaaggcttcttatgacctagatgtggaagtcatgcagtgtcacctctaccacattctgttacttatacagggctagtcaagaatcaagcaggtgggcaggtatggtggctcatgcatgtcatcctaacactttgggaggctggagaaggcagattgcttgagcccaggagctcaacactagcctgggcaatgtggtgaaatcctgtctctacgaaaaatacaaaaaaattagctaggtgttggggtgaacacccatagtcccagctaaccaggaggctgaggtgggaggatcacccaaacctgggaggtcgaggctgcagtgaaccatgattgcgccactgtgctccagcctagatgacagtgaggccctgtctcaaaaataaaataaaaccaaaccaaaccaaaccaaacaaaacaaaataaaataaaaaagaatcaagtgcacaagtacttgagtacacaaggacatcactactgggaagcatggttcattgggggccacctttggagactagctgctaggcttgcctacattataattaaactttcctacccataggagcatttctatctttgtcagatcaatagtagcatcacttaccatttaactacaaatttctaatggaagtttcacctgcatgtatgaaaacaaggtttccatcaaaggtaacaaaacaaatgaccaaaagtgtttttgctaaagaatttgtgaaagctttttcattagctgaacacccactggagacatcatgctttgagactttctgacctcaatccctagacagaaaaagagttggtgtctcccagtttgcaagcagtcctggggaagtaggttggcaccgatgaaccctttacattgattatcttaggcagctcaattcacttagttttcttcagttgaagaaaagggggtagcaacaccggataaattttaggggcacttctctcctgacattccattaatgtgccaatggcttagtgttttgcaaggaacttcacagaatagaacagttcggttaacttctggttgttgtaacgcatttttacttaataatctctcttgtctgtgtttcaggtcattcatggggatagagtaggcagggtgtgtagaatcttcttccatcacagcatgaaactgagtgaagacttcagaccatgacatctgcagatgttgggcttcagttgtgggttcgtaaattctcgagtttaagacttgttgccatttgctcaatatttttgatccttggcttcctcatttgtaaaaaataccaaacccataattttgttggaaggaacaaaggagctgaactttaagaccctaccctaggtctccctactactgggctattttgttgtttgtttgttttttttgccttttaaacctcgcttgaatgatttaatagttatggtgtacctgtagcttttagttaccacacatctctttgagaagtagtcagggtatgaataatacacataaataaaaaatgagtgaacagtatattaaagcaaagtaagcctgtttgaaaatttggactcaaaccatagtttcaaacccgtaaaaaatatttattgggtcactagtatatatagtgcactgtgctaggctctgtagaggactgaattcataaaagcaaaagctgcctttattctacttatccagaggttactgaatttggagctagttgacagttatgccaggagaacacaccagtctgcctgcctgtcaaggagagaattaaaaacttgtttctgctcagtgcacagcagacagcccggaaagagtcttatgaaccaagcactgcaaacaaggccatatctcctcctttccagatttttataagtaggtcaacaatagttcaggaaagatggaattccagatctaagaaaataattttgattgaaaaagatgcaaaaggcagtagagacaaataagagattccaatgattatcagtggtatttaaaacaaaacgaaatagcccaaaacaatcacatctactactacgcattcattaccacggagacactaaggatccaccgggccaaggtgccatgtggggactgaggtggtgtgtgtgattgggaggggttgttggtagtgaataatagggcttttagtaatgcacaaagggagagatgagacagatacccaaataactgtaattcaagagagaaagtgctaagtattaaagaagactgaagttctaaggaacgagaaatagcaccactcaggcaacatgaggaaaacctgttgaatggggaagtcagacttcagcctggccttgaaacagaggtggtaatagttagcgatttggtttggatgaataatagagtttgtgaatggaagaagtggaagaaaagtctggaaagaaggttgagaccagactctagagcatcttcaagattgatgtacagggtttacgttttacttggaaagtgttatcacgtaagaatgcagccagctgcaattgatggaaaaatagacagtggtttacatgagaaagcagttggtttactctatggaagaagaagtcaggaggcaggcaggtgagggttggtatggtggctcaggaggccatggaagacttaggctctttccttttgccccgccctgtcattctgcacaggtagctttcactctcacgatgggaatatgactgctcctcttccagccccatgtctgcactataagcaggaagaaggtttaagggtaaagggagggccaatcccctcccaagactgtcacctacatctcaccggtgaggaatgtatcatgccatccctacctacatggggggctgagaaattgagtattttctattttctgagtctttggcaaagaaagcccagggaaaaggtaactatgagtcccttttgagtagctagttcatggcattcgccagagaactattatggtttttgagcaggggaataaaacactgcttgatgattaatttggctgtaatgcatggctggacttggagagaatagttacaaagagaaagatgagaactcaaggtgcagagacatgaagtgccggattcatggtcctgtatgagtaagtggtggaactgggatttgaatccaggctagttgttcccagcctttttccacctatctctcaaagctactcagtaaggactttaacagaactatctcttatatagagccatctgcataaacaacaatgctaggaagccattaattcatttattccttcaattctgctttaattatgtatactgttgttttataaacaatcctgggagatagtataataaaaggaaataatgagaattcagagaaaggtagagataagttcaagtccagccatttctcttgccaatggtgtgattttgcatgagtcacataaattctctggctttcaatatccttagaggaataacaatggcagaaatgtataaaatgagataatcttgttatggcaaacatatggccaatatgggttagttggcccagcctccgttccaaatttattctccctagccaattccggctaaggcagttggtgtgttactattctggccaatcagacataggtgggatcagctatagtctcaatgatatttttacttttctgattcaggttcctccattttatactcctttcttcctgctggtgggcatgatggctggagttgatgcagtcattttagcacaatggggaaaagaccacgtgagtactagaggcttcattatgaataacattgaacaactggaacaacgctagcagctgcaaatcctcaaacttctcattatgtgtcaaaaataaactacttgtattagacactatggctttatttttcattacttccagttaaaaacacttaaaattgatagtttataaaagcacttggtacctactttatgcttaataagtgatgtttattattattcttgtcatcatcagtattattgttattgtttttataagttgcataatatcaagttacaggctaacagataaaaagactataatcaaaatacataaacaaatatgtgatatcctaacgaaaaaataaaaataaagccaccatgaaggattgagagtaacatgaaaccacactggttctgcgtgggtggaaattgtctgtacggatgttggaaaaatccacgctctaagtccgaagccagggttatagtaaagggcaatctttccagatgcagaaacatagcaaccatggcaggggatacgggaagggaagcatttctactggggtattttgagtgatgactgtaaaattagtgcttggactatacaagagggattttgtctctttgacttaaatacagtgttcagtgtttatggggataaaaagtagtcaaactaccaaagagagtctggtttctggtaaagaatttagaaataggaaaagctaaggtccatggaaatgaattctctgaccttcagacttctctagccaactactgagtgagataaactgataatctataatgtatgctaaattttcagaatgaaactaaagtgcaaaattgaattgtacgaacaatagacaccatgaagaattaaaaggcttattttttaaaagtaactccagtgaataacatagcccaggcatagatatgcttgccaaacaagcaattgacccagtaaacaacatggttattcagacaaaatcagagatcctgtatttgtgaggtcaatagatcaaaatttttatcaacttatctattgtctctatatattcacgtatacatttttgaaaaatatttgttacaatttacaaaaacacatatatggcaatagaataaacaataaaaaatttagaattcaagatagttgactatgcatgtctccaacctcatatcccattaaatgacataagatattcacaaagaggacaaaattataacaccactagaaaagtatagggagcttgtgtttggcagatctgaatactgaggaatttctgaaagctgtaaggcagatagcaacacattgactgagaatatcaaaaagctaaacaattcataacacaaaatggaagaaagaagaggctttctcagcaaaattctgggggactccaagatcagggggcagagaaaggtgagggatgactgaataaagagacctgaaagagctgtcccgttcaaaaggctgaccccacgtttgtcccccaagcaaagctgaaagaatagcttcctgaataaactggtgaatcatctgtgagaggtttccagagtgggcactagcattaaaaaaattgcagcactgaactcccaagtaactttgattaccataatgggctactaaaggataaagtgtcatacctcctaaagaaaagacttcccagtgccccaatccctgaaaggagccagggcttctgtcttaagaatttatacccattgttggagatacaatttttttcatgtaaggagaattacatttcaggaaccaattctattttcttagatcctgatttataaatgtaaataagtaattttattcctccaaaggaatgccaccctgttgacatcttgattttagccctatgaaatccatttcagattctgacctctaaaaaattaaaataatgaatttgtgttgtttgtagtcactaagtttgtggtactttgttacagcagcaataggaaactaatacacatggagaacagactcaatagacccaataactctgtagtgagaaatcacaaggaaagaaagagatacagatggagggtatgatgtaatcaaataaataatagaaagactgacttgaagctggaaagggacttgagttttcagagaagaaaaggccaactgagtcccttatggcaaaattgtaaaaaaattggaatccctaaggataaagaaaaatcttacaagctcccattaaaaaatacattttttggtataaatgaattattattctcatcactgagcccattatttatttgagctaagtattttactttaatcttcaccacaccaggaccctataccacactcttatctacttgcatgcggatatggaaaaagaggatccctgaggttatgcagttctacagttagtaagtggtagaaatggaattaaaagtcaagttcagaaacatgggattctgaagacaattacattatttgctagcatcaaacttctcatttacaatacagaaaacaggaaaacaacagaccaatgcctgtaaaaagttaaagaagtacgttttcaagctcaagtcctatcattaaagtatggggcagaggggaatgacatttttagacatacaagaacatagaaggcttaccacccacataaccttttctgaaaacaaagcaacaacaaaatcttcaggttgtacttcagcaagataaagttgaaaaacagaaatacataacataccaataaaatgagcaatgatatcagtaaaacttatagttaatactaagtaatggttgaaaatatggcagtgaaatttaatggaattgttaagtaggtagtcataaaacagaagaggcacaaagtaaaaaattaacaatctggaaccaaaattcaagataatttttaacaatatgaaagaggtagtaaggaagaaacaaagggaagttataaaataccaatgatacaacctgtattttgtttaagcgagattgttgtagacactgctttatttttatttggacaggaaaacaatttctgatttcggcaagtttaaggatgttcactagcagaacaaaaatgtaaggtgaaaatttcaaactactatgaggtaaactgtaaataaaaaataagaaattaaagaataaaaacataaaataagaatatatgagacaatataatgaatatcagttgaatttttctaaactattctagaaataggcaatgttccatgttatttttttaaaaaaatcaacttcatcaaggtattatttgcatacaataaaatgcacagatttttatttatttattctaagcttttatattgggttcaggggtacatgtgcaggtttggtatataggtaaattgcatgtcatgggagtttggtgtacaaattatttaatcagccaggtaataagcatagtacccggcaggtagttttccagtcctcatcttcctgtccccctctaccctcaaggaggccccagtgtctgttgttcccttctttgtgtccacatatgctcaatgtttagctgtcactcatcagtgaaaacatgtggtatttcgttttctatgcctgaattagtttactgaggataatgagttcagctctatccatgttactgcaaaggacatgatctcattccttttatggctgtgaaccaaggtgtataagtaccacattttctttctccagtctaatgttgatggacatttaggttgattccatgtctttgctattgtgaacagtgctgtgatgaagatacgcatgcaagtgtctttatggcagcacaatttatatatctttggttatatacccaacaatgggattgctgggtcaaatggtagttctgttttaagttctctgagaaactgtcaaactgtttccacagtggctgaactaatttacactcccaccagcagtgtataagcattcccttttctctgtaacctccccagcatctgttactttttgactttttaataatagccattctgactgatatgaggtggtatctcattgtggttttgatttgcatttctctaatgattagtgatgttgagcattttttcacatgcttgttggccatgtgtatgtcttcttttgaaaagtgtctgtccatgtcctttgcccacttttaaattttttttttaatttgtttaagttgcttgtagatgctgggaattagacctttgtcagatgcatagtttgcaaatattttctcctattctgtaggttctctgtttactctgttgatagtttcttttgctgtttagaagccctttagtttaattatatctgacttgtcaattttgttgctgttgcaattacttttagtgttttcatcatgaaatttttgccagagcctatgtccagaatggtattttgtaggttatcttctagggtttttgtggttttaggttttacatttaagtctttaatccaccttgaattgatttgatttttgtatataagtgaggggcccagtttcaatcttctgcatatggctagccagttatcccaacaccatttattgaatagagagtcctttctccattgtttttctcaactttgtaggagatcagatggttgtaggtgtgaagctttattttgatctgtctattctgttccattgttctgtgtgcctgtttttgtacttgcaccatgctgttttggttactgtagccttgtagtataatttgaagtcaggtaatgtaatgcctgcagctttgttctttttggttgtgattgctttgcatattcaggctctttattggttacatattaattttaaaatggttttttctaattctgggaagaatgtcattggtaatttgacaggagtagcattgaatctataaattgctctgggcattatggccattttaacaagatggattcatctatacatgagcatataatgtgttcccatttgtttttgtcatctctgatttccttgagaagtgttttgtaattctcattgtagagatcttttacctccctggttagctgtattcctaggtattttattcttttttgtggctgttgtgaataagatcatgttctagatttgactgtcagcttggatgttattgatgtatagaaatgctattgatttttgtacattgattttgtatcatgaaactctgctgaagttgtttatcagatctaggagcttttgggcaaagtctatggggttttctaggtatagaatcatattgtctgcaaacagagatagttggacttatgctcttcctatttgggtgtcttttctttctttctcattcctgattgctctagctgggacttccagtactatgttgaatagaagtggtgaggctggacatccttgtcttgttctgcttctcaaggggaattcttccagcttttgcattttcagtacgatgttggctgtgggtttgtcataagtggctcttattattttaaaatatgttttcacagtgtctggtttgttgtttttttaaaatgttgaattttattgaaagccttttctgaatctattgagatgatcatgtagttttttagttctgcttatgtgataaataacatttattgatttgcctatgttgaaccaaacttgcatcccaggggtaaaacctactttatcatgatgaattagttttttgatgtgctgctgggtttggtttgccagtattttgttgacgatttttgcatctattttcttcaaggagagtggcctgaggttttccttttttgttgtgcctcttcctgtttgtttggtcagaatgatgcttgcctcgcagaatgagttagagacaagtcccttctcctcagcttttaggaaaagtttcagtaggaatggtgccagctctttaacacatctggtagaatttggctgtgaattcatctggtcctgggctttgtctggttgataggctttttattattgattcaatttcagaactcattcttggtctgttcaggtattcagtttctttctggttcattcttaggagattgtacatttccagaaatgtatccatttcttctaggttttatagtatgtgtgcatagaggtattcatagtagtctctgaggttttttttaatatttctgtggggtcagtggtaacgtcccctttgccatttctggttgtgtttatttagatcttcttttttttctttattagtctagctagcagtctgtcaatcttatttgttctttcaaaaaaacctcctggatttatcttttgtatggttttcccatcttaatttcatttagtttagctctgattttgtttttttcttgtcttctgctagctttggggttggctggctcttgtttttcttgttcctctagttgagatgttaggttgttaatttgagacctttctaaagttttgatgtgggcatttagcactatgaatatttttcttaagttggaactgctttagctgtattccagagattctggtatggtatatctttgttctcgttagttcaaagaaaattttcaaagaattttttaccttgattttgttgtttaacaaaagtcattcattcaggagcaggttgtttaacttccatgtaattgtatggttttatgtaatcttcttagtattgattcttatttgattgcactggggtatgagagtgtggttggtaacatatatttttttgaatttgatgatgatattttaatgtcaattttgtggttgattttagagtgccatgtgtagatgagaaaaatgtatatactgttgtttttgggtggagtgttctgtaggtctctattatgcccatttggtcaagtgtctagctcaggtcccaaacatatttgttagttttctgcctcaacgatctgtctaatactgtcagtggcatgttgaagtctcctactattgttgtatggtaatctaagtctcttttaggtctctaagaacttgttttatgaatctgggtgcttctatgttgggtgcatatatattcaggttaggtcttcttgttgaattcaacccttagccattatataatgcccttctttgtattttttgattgttgttggtttaaagtctactttgtctgaaattaatatcaactcctgatttgttttccatttgcttggtagatttttctacatccctttactttgagactatgggtgtcactgcatgtgagatgggtctcttgaagatagcatatagttgggttttacttctttatccaacttgccgctctgtgccttttaattggaacatttagcctgtttacattcaattttgatatgtgtagatttaatcctggctttgtgtcactagctagttgttatgcagacttgattgtatagtggctttatagtgtcaatattctacacatttgtgtgttcctgtggtggcccataatggtctttcctttccatatttagcattcccttaaggacctcttataaggcaggtctggaagtaacaaattcccttagcatttacttgtctaaaaagattcttatgtttcctttgcttatgaagcttagtttggcaggatatcaaattcttggttagaatttcctgtctttaagaatgctgaatataggcccccaatctcttctgggctagggttcttgctgacagagccactgttagcctgatggggttctctttgtaggtgacctgccccttctctctagcttactttaacatttgtttctttcatttcaaccttggagaatcagatgactatttgtcttggggatggtcatcttgtatagtatctcacagaggttctctgtatttctcaaatttgaatgttggcctaacaaggttggagaaattttcatgaaccatatcttcaagtatattttccaagttccttgccttctcgctctctctttcagggatgccagtaagtagcagattttatttctttacgtaattctatatcccttggtggttttgttcatttttttctttatttttgtctaagttattttggaaaagcagtgttcgagctctgcaattctttcctcagcttggtcaattctgctgttaatacttgcaattgtattataaaattctcgaagtcatttttcagctctatcagatcaatttgattatttcttaaaatattcattttgtctttcagctcctgaatcattttgttatattccttagattccttggattgggtctcaactttctcctgtatctcaatgatctttattcttatccatattctgaatttaatgtctgtcatttcggccatttcagcctggttaaaaaccactgctggagaaccagtgcagttgtttggagctaagaagacatcttggctttttgatttgccagagttcttatcctggttctttcttatctgtatgggctgatgttcctttttatatttgatgttactgtcctttggatggatttcattgcttttttttccctttgatgcctgtgggtgtttgattgcggtataaagtgggttcagtcaactggcttcatttctggaatattttagggggcaaaggctcagcttagtatttctgggctgtatgctctaactctgggggcctggtacccagcccccagctttgttctctggtcccttgaggttagaaagctgctgtacaagaggggctgaggtattccctagccacaatactccaatagggggtgccagccaaagtgttttgttggggcagtggccatgggatctgtgctcactcacacatgccagcaactgcagcagcatcatggggtacacgtgttggctaaagaaaggtaccagtgggagtagggtgtcagtgttcctgcatgtacttgcactggcagtggtggtggtgtggcagggatggggtactagtctgaattttttaatttaaaggactctcagtctggagctgagattgcgccactgcactctagtctgggtgacagagtgagactccatctcaaaagaaaacattaggtacaccatggtaattttaataatgatgacaatgttgttgttgatgatagcagcagctaacatttattgattcctcattagaaatcattaggaacagattcaccctctcattttgtcctcacaacaatcttacaaagctaagttataaagttagtataagataatgttaccaagagtttaaaataaagtggagaaatggaaaaagcaagacagaaaattttatcttttataagggaaaacaacttactgaaaaacctggaaagaaatacagtatagtactaatagctgctggttctcaaaggtaaaactatgtgtagtttttcctttcatcttttctgtcttatttttctcttataagcccttgttacaaggggaaaatacaagaaaatgtatttaaaataaacagacgatgtgcaatttcatttctggagatgactaggcaatgttttttctcaaaggatcttttggggcctcgagaaaacctaggttagattttgctattcatcaggtaaaaatgtatttcctaccattctctgttggaggcaccatagcagaattcagcaaaagagaaacatggttatagattgctcagagatagaaagatgtctctgatgagtgataatgtaaagaaataagtcacctcaggtgtcatgatgatttatgcttttctcagtaaatttaattttatctttttttccccatttgtgccttacaagagccctgagagactaggacaccaggcattatcaatgcccatgttacagaaaatgaggggcagtgagcatagttacctgccaaggccacacaatgagctagtaaaaacctgaacacagaacacaatcttaactcttaactcagtgctttcttccatgacaacagcttatctgggagccctgattcctcttggcaggaaagacaagcctatcaatatatcagctatctaagatatttatggatgaagattctgtgtaatgtctgctgtaaattcagtttactacaactctcagcaaaatcaaaggaataccagttgtatcccaccttttactctgccattcatgcaacactcattgattgcatgcagagaactatgaaagtgttaggcattcagtgatgcttgtcttcgggtagcttatagtggggaagcagttaatcaaatctagaagtataacacaatggaatcagtaacgtgaaggagacataatgaagtgtcgtggctctcagaagagggacacgctgctcatcattcattgactcattcattcaacaaataaaaactgccttcttgttgccatgctttgtgttgaattccggggatgcacagttaatacagacacatgatatttatcctcaaggattatcatctagtgggaaacttaagattgaccaaatgattatacagacgtacattaaatcagaagtgataaatatggcaaaggatagttagtggtgtaagaagcatgtgatctagggtgagtttcttctgattcaagggtgagtttctttacagccctctactagaacatgagaaattttgtatttcctccaaggcttggctattcaaaggagagtttgcaggtgctgattggaagtggcttacttaatattgcttatatcctttattgtaataatctgataggctatttcttaccacactgccgcttccttttcctccttcacagccctgcatatagtagatggtaatcttcctgttctcagtttatatatggagtgtaatgttggactgttcctctttgcccaatgagccaggcaaacactaatggagagaaaactgcaatcatatccacagtgttcatagtaaaacattagatcccaacctgaagcatcctctgctgagggtagcagatggcatcagggtgcctatgttagaagtaatgcaaacctgattatactctttctaattttttcccctcctacatgaagcatgctgtagccacctcacagaatatggtgatgtgtcaaaacttaattagccaacacttgtaccccatctacattatgtcaaaaactacactttcaagaacaagagaagagagctccaaaatattctggcaggcagagaattcttagaacacaaagaaagagaataaggtagtaagctattttctattatcaaggccttaattctttcttggataatcagaaatgggagaaaattttctgggttccctggatgtaccagggttgccatatcttctatacaaaaatggaaaaatctatgacctgacatgtatgtgggaaacgtatggtctggtgtgcatgtatgtgggactagaagcaggcatgtttgaagtaaatacagtttctgtttatctggtatgcatcacagggtgaccaacccaccctgtttgctcaggatggaggggctttctaggatgcaagaatttcagtgttaaaactgagaaagccccaggcaatctgagataacccttgatgtatgtaatgtatggctcttaaaaaaaaaaaactcttattatattcttagaaggtcatgttgaccagtacagtgctgtcgcctttgttctctcctttgaccaatgtggaggaatgaggctgcctgcttacaggaatatcagagatctttctaattcctaaactggctcatctatccaaacccctcacccctctcccaccatttttcttttcctcaggcccagctccttgcctcttaatggtcatgctcacagctttggggctgaatactcaattagccactgcagcgcaagaagagtcccccagcttcatccatcctttatccatgaagaaggcccagagctccttttatatttgctagggatttttcaccagagtatagaaaaaaagtcacgtgatacacttttaagtcataaaaaggacaaaaaactcacaataaaaatatgcatttggaaatcttatatgcataaggagcaagttctagctcagtttgtttatatattaagttcatgcccaagagggtcaatgccttctctaatctatccctaagcccctttacctctattatttgcaggcttggtgagggagcctctatcctacgctgcttctgcttctcatgcctatcggaggcaatgcatgtaatacaaaccctatggaattgggacctctccagcttgttcagagctggttgaagctccttgctctgccactttttagttcagtatacttagatgaattatttaatcctctaaatctcagttcacttgttacattttcacagagacctagaaacattaaaaaatactatttacatgttcccaacctcctaaggtggctgcttcgtttgctctcacattcagcacgatagataattgtaaggcatacaagaatttcaaccatcaaaggtgtaagtaaattctctatattctcttcatgatgacaaaataagcagttgaatatttgccctaagattggaaatcaaaaagtttatccatcagtgctccataaattgcagttgacgcttccctgtggcactaagacagctgtcaaggtggaaaatggggcttaggcttggagataggagtctttgcgcaaaaggtttgcactgcctcaggtggagttaattctccctgacctcataggcccattgtaaagattaattgagaagtgatctaaaagtgtatgacacacagagtaagctcttgactgttggttaagttgggcacacttcttttctcctgttggcacaaggcatagaagtgccacatgctagtaagtggaatttctatcattttctggctctcctccttacctgcttagagtttatggcccatcatccctatcagtcctttttttttttttttttttttttttacaactctaccctttgctgctgtctttcatcaaacaaactcacctgtcattccttatagctggttggacctagctctctgccttctctgttcttatccccaggctatttaatgaatctggataaagatatacagttatcatttcatctgtaaccataaatctcaagtgtgtttcaccattctcccacattactctagtcaactcacgctcccacattcagggctagctattttattatctgccttccccatcacccaaatttccaattcccgctcctcactctcagttgatgaccttgattctcatttgagaatataaagcagggctactttatcctcccacaaccaaacctacttccccagctgtacccacacagaaaccctcctctgtccctccagttatgggggtaagctgtcccttcacctgctggtggccagcacctcctttcttggataggatcctacattatcttgcgtggaggaggacttgacacctacagagactctgtctttccttagcatcaccagtgaattggattattcccatcagtacaagtatatcctaatatgtcctggattaaaatatatccttattttgatccctatttctctctagctagcctacccccattttgtgctcccttttatgtcaaaaaatttttaaatagttttttatactgtcttcgctatctcattctatattcatttatcaaccttccaagcaggtttttccccccggtattccactgaaactgctcccatcaatgatttctgtcttgctaaatcaaatgatcagctaattgctctctccaggaaaaaactttgttcttcttttggcttttatggcaccacactttctggatgtccctcctttctcaccggatgtgccatctcggtctccattgctggtgccttccctgcctgccaatctctaaacgtcaggataccatagcactcaattcttagccctcttttctaactacattcactccctggatagtctaatgtatgcccatggctttaaatatttgttatatgccatggaccaacaaatttatatcttcagccccactttcttagtttccagacatgtattttgcctatttgacatttctatttgcatgtttaaaaggcacctcaaactcagtaactccagattagaattcctgatctcccatccctgccaaagtccactccttcctcagtcttctctatctcaatatatcaaagggccattcactcaatgactactctccttctctcacaaccaatgtccaatccatctgcatgtcctgcttgccctacgtttgaaacagatattgcactacatcacttatctgcaccttgcatcaaccatgtcttatgtctcttccagatgacacagtggtttcctagtgttttgtttccatccttaccttgtacagtcagcttcacacagcacacagcagttggagtgatctttcaataacctgtaccaagtctttccaatatctattgaaagctttctagtggttccctgtaacatcagcattaaaaccaaactcctttccatagcctatgtggctcttgacaatcagacttttgaccatttttctgtaacctgaattcgccctctgctcactgtcctctgttcatagtgaccttcttcctgtttatggaatgtgccaagtctgtaccacctgatggtctttgagcagctgttctctttggctcaataatcaacttcctgctgttcacttgcttactccacttaggttggctcaaatgttggccatttgaggaagaggaaggaagaggttggctcctcttccttcagtggggccttcccggctgccccatctaaaatagcaaccctggccttttttcattctgttttatttattaacttaccacattaaaaatattttacatatatatgtatatatgtgtgtatatatatctacgtactttattggtttaatatctgttcctgaccagatccctcttcgaggctgaaggacttattcccccaactgctgggagttctcagtggccatctctttcccaggattgtctttagctgataagagcccctgtgcaagatcgcacctcattcccagtgagcccacagtcaatgactgacctatacacctgtctaaagatgagggttccctcgccacaatgggggaccattttgaagggtcatcccagtttcagagctttccacgaggtcagcttcagcctttgttgagcctgcttcacggtccattccttctttcttccttttccccgcaggacttaagcccaagagccctttccaatgaacttcctgtgcacaatgtccatgtcagaggatgtttcctggggaacctgatctgtaaaaccttcatgaaaacataaggttcaccagtgcttagacctcatctgtctaattttcagttatcttcccagagcctaaaacagtgcctggcacatagcaggtgttcaataaatagtgagtaaatgaatgaataaagtagaagggctgggatcagacccagtcctgtgtgatctcaaaggcactgtgttctctgacccacaaacactaccatccaggcaattccaacttacaattagaaattcagttccatttgaaattctgcccttgcttctgcatgcacctggtaccagatgaaacttgcagttagttaaggcacacagattaattgaaagaactcattcccacaaatggtgaccctgggagagctcatgcatggcagtgtaattactttggtcatattgacacatcaggagagcccagagtcaggctcagcctgaggtttccatctgaactttgcatttccgtaggcctctctcccttgaagtcaaatgacataattttaacaaattttgagtgtgtgaataatttcttcttttcttctgccctggtatgtatactgatattaaagactagaatatttatcatgttggcagttcctgcctgctagatttgattttgttaagaagccgagttttcctctgacagcattcaactccacatcttcttattcttgacttccactttagacactttggtattagctagctctacaccaaaataaaatgggagggagccaataggaatagctaagtatactgaccacattcattcctgactactggggaaacacaaatccagttactaaataaaaagccagttcagataaggaatgatgctatatcttccaaatgactcctgtcgcattcactggattaaaacccagagcgtcaccacttatattccagtgatgtatttagtaccctactttaccaaatcactaggaaagccatggactgtaacatctgtccaaatgcagagagaatcaaactctgattatgctaatctgatatcgacacaaagacattagtaaaataggccactctcactgaataaaatgtccttggctttcataactgattttttgacgtcatctggttttctgcaaaagccagagatagagctgcttacatttcagggaagactgtacctccagtgaaaacatgctccagcgcacatgatatttcaaagcagccgtgctatctttccatagccactataaatgtgcaggcacttcctcgtcacaggtgagatagaaggtgaaaggtgtactgagatatctctttcctagcctctgttaaagacaaaaaaactcattttttccagctaaagcaataccaaagatgactggatgtcatccctggttctgtagaattacactgaagggggagctcagagttctttggaactggaggtcaggcttgcagaattagtcactatttatctgaagaccgagaatccagcttgttaccatgatttcaaggaactgaaagccacacaagtcaggtgaaattcagaggtaaatgctacaaatttgaaaaggggaagctcagtgtcctctgctcttttttcgagctattttgagacatgggaagacactaaagaaacatggcaagtattagaaataaaaagcaatcctttataagaacaaaattacagtgttgagatgaaacggaacctgtcaatttccaatcatctattcagaggacaaagaccccatttcagggaatcttctacagatgttcttttgatagctttttatttaatagtcaactggaggctcagctttttataatttagtttcccagaaaaagcatcctattctcttagatcatttagtacctctgagatttgcagtattcactcttccgcaatatttgcatctcatcgatgttaactgcagaaagtaacaagaatgtcgagaaagactcctttcttcaacagcctgcctgccatcccataaccaccttctctattttcactgcactggctcttttaaactactgcaagttcttccactctgtaattggaaaaatttttcgcttcaattttaaaaattatagacatgtaataaaatgttgccctgcactgcttgcttaatctatctgctcctcctcttatcgtcatcgtttcttttcacatcctggtgactgaagctgtttaaaccagatgcaccatgagaagcagggtaataggaatgaataacagaaggggaggctcatgtccttttgtgggttcatcctggaaggtggggggaggagaggcttagagaggggcatggtgagagggcagcattagagacaatgtactcaatcccccttgatcctgcccttaagctctttcagaaaacttaatctccaaagatttagtttaattttgattataaacaaaatatccttctaccaatggtaactgataacaacgaaagagcagggaaacacaccagctgatgtccctcttctgaatcagctgttcctgatggtgcacagcttcacttaattgttttgttcttccttctaccctgcctcattccacaagagttgttatggcttacaggataagaaaaacatattgtatctaacattacgtttaacaacaaaaacaacaacaaaaatcgaagcagattaaagacaaattcagatagaatggcaggatctagagtaattcaccagtttataaagttcctctaactttattacaagtgaaaatttggttctgaaggccttgacactcaaagggaaatggacaacgtagttacgccgttcttgcagagaggaaaaataaaacacatcgattgttcaaaggaagcaaggtttttcctagcaattagggttaaagaaatttctcatctggggcttccttcaggaagacccaatgacacaatgtcctttacaaaatgccaacagcaattcccccaaactgctcataaaattaagttttgcaaagcaaaatgaatcttaaatgtgtttgtcattgcagggaggggacacatttggtctgtaagttatcgcctttcaatttatcacttttgtcaagtctgaactgttctatgttaaattttcaagtaaaagccagtctctgcagtgaaaagaatgtgggtggaagacataggtgataatgcaccttggctagtggaagaaaagtggagacggctgtgggccgattttgaacctaaagcattatgtgacattacgtggttccacttgcccctccaggcgcttttaatctcagtcaagaggccatgctctaggtagctgctgcctcttcaccctgggccatagaatacatctgaccttgacttgaagcttgaatcagacctcccccagcagacctgaagactcatgagcaagaaatacacgctgatgttttataccactgagatttttgtggtggatagatagcgttattgcggcaataacttactaacaccctgccttgacgacttcatgaagttgtgcagactaagtgagagaatgctcttggatattattcgcatatccaaattgaatgagcaaatgaagagttagagaaaatgattcattctgcatagcattaccagatccattagttgacatgttatatggatgcttctgtattgcaataggccctggttgtatttggtctgccaagcaggaatgaaacactgagttgagactgctggttggaatgatacaaaaaggacaatcgagaagtgcaaaagaatgagacagaatagtaatgagctacagaaggagtctgaaaaccaaaatggaagtctagttggtctataattaggcactaatcatctgatatgatggagatacctctgcagaatctgtagaattttgaattatctacttgtcattttctggggaacatcatagaagtgataatgaaatcactcaaatttctggatattcttcaacctagcttggccatcctagtccaaaaaaatataataagcatttatcaagcaccgacaaacaatttcagtgcatattaattgggcacctactatgtgccaaataatttgcagcctcagagataagcaaacagaccattagacatggttaaatgtatgacaaattataattacatgagcaattactttagtaattcatgtaaattactacacttcatgaagactaacaagtacagatatcacattctataaagcccacaaatctagcacctatttcaccatgttatatgtagcaccgttacctcttttgtggactaagtagtatagcaaacttgatggaataaataacaccgacttcaaatcacaagggtattacatgagtagcctctactgacataatttcaagggtcagctatttctctgtaaaattaaaattaaattctgaaaacactatgtgctaggcacagtaatgggagcattccaataagctgtaatccttaccaccattttaaaatattagctccagtctacaagtcaggaaggaggctcaaggaggtaaagtaacttgcttagggacccctggagtccaagtgcattccttgttttcatgcatcctgccaacttcatagtttatttactgtgctccatatggtgcagtcactaccaagcaaatggcaatgaaaaagaaaaaaagaaaaaaacttgcctgccatttctcttcttcatagctagtgaaagagtttactaacatcagtgtcaatgatcataaagctaaaacgtcctaagccttaaatttgcttttcaaataccagtatttcagaggcagattacctgactccaataatatgcctcaaaccttgcactgtgtgtgcaatgaaagggaatattttcatccattataagaggctgtcagaggaaaacattttcctgatatcatacccaagagaacagcatgtgaagcaacactatcatattctaccgaactttcatatactccatgcagtacaatgtatattttatcttttgaaaagccttggtaacaaaaggataaaatatccatctaaaactcaaagtacattctaataatgctgcattcacattaatagcattcaaagaatctcatagccttctgcaggcagttcacttgtctgtgctaagaatctatccttcagttacaggaggaaaagctcaacccagtggctttgcccactctttatagctggggaagaggcagaagctaaggggcagtgtggaaggcatccattaactaagtcttcctcctgaatggcaggctagtgggaggaatttctttcccgtgcacagggagttaagtcggagctgaatttgcatatctctttagaatcacaagggtattgattctagcctctaagacatttacataaaggtttcaggacactctcaggaaatagcaaaggaaactttggaactgagagtgagaatccccagaaaagcaggggggaggaaatgcaccaatttttggcagttgaagaactgaaggcagggtgagtctaaagacatatatgcctaggagagacatctttgtgttggtgactcagtctctgagtctcacctggtgcagttcactcaaatggtatcctagcaagtcttcagggatcctgttttaaattgtttgtctgagatttttgtgaaatttgggaaagccatgccatcttctgggaaactcgaaagaagactaaagtcccttcaaggtcagacctttcaggcttgggaacaatttatttgctttggagaaataccactgtcatgatgggagtagctgtgtcatgtttcagcagtgcttgcaagagtggagtgttagagaagtccgaatgaccgcacctccccaagcaccagcctccaaggaaacatatgtctcccaggactgtgcagaagggatgaccctgggaggctggggtaagctggcagcaacagtgtttggtggggatgctgagccaaataccattgcaatcaaagcctttgatcatcctcttgttggtgtgacttgggaactgagggtcacccttgaattcctttcagtcttaacactgaactaggagaagcacaaatcttaaatttccatctattaccattattattatccacagagaactgagggcagcctgagaaatgaatggcagagatgtgtcagctttgcccctgttaaattatgcacatcatatgaaatgacttaaaggatgactgcctaggagaaacagagacaggccatttacactggccagtcctttgaggctcatgactttaaaagttattcctgatccactctgagccctgaggaacttggaaatgtgcctattacggtttccaaagtgcaatcatgcttttggggtgaacaccccagctgcaaaaacagtaaggtctgtcctcatttcacagtaagagacagagccaggaagagaggctgcagaggagacagagagagcaccattgccattttttacagagaaaaagcatacatatcgtgacctagaaattaaaactatgtgttttcccctgactctatggctgccagaactgcttcagtgatgacaactatcttgggcattttatgtgccatttttttgatggaacgtgtaaaaaaattaactacccattcagaaatgaaattcactatgtgatttgccaccttgccagggaagagagcaatggtcagataacaaaacagacatgtaacaccactcctaaggataaaatacgtatagtgctagagccaaaacaaacaggctgcagagatgcaattaataggctgaaatatggtggtatcagagcacccaccatccctcatgctctcaaaacatggcaaagagaaggaaattggctgaaggtcagggctcttctgacccatgctgccttcttcctaagcccttgatatagatggaatgtatttctcccctgtcttcagtttcagtgcaatgttctgtaaaggaaaccagttttggagtcagacaacctaagattgaaactcagctctgtttcttgtcatctctgtaactctgggtaaattatttaacaactgcacatttcagtttcctggtttgtaaaactggccatctgaggtcatttggggaactaaatgagataaaatatgtatgtataaatggcagtagtaagtactcaatatatttagttcctttcccttttttcatctatatgtaattccaggatctggggtattttagaattcatctatttattatttcattcaataaacatttattgactgctttctgtatattacatactttgctgctaaccagatgctgacacagccataaaaattagtgggccaaaaggaacccagactgtagattgaaaggggtcatctttatgcacatcttatgcctcatatctgttgatgtctcaagcatcctacagggatgttacaccatccacgtaggaaataccagatctcacggtaatcggcaaggacaatttgttcgtcaaaacagattttgttgctcccacttgaatgcctcctttagaagtctctgttattaattcacctctgaaaggtgatcaacaaactcttacattcttccctttggttaatagattgattccgatctattaaaagtcaaattaaagttctcaccaagtgtgtaatcctgggagtttgtgtaacattcagctttcccatgtcttcacaattcttttaattttatatttctaatcacagaggccaacaacacagaacagtttgactatattaataaaattacttatttatatattatctgtgaccacttcctttcccccattacattcctccaagtggataacttacagttattaactttcaggaggcccctatatatcatagcatcataccattaagccttttggaaattcatcacaaatcagtatacagatgacattgatgtcttattgctattcattcctcccgggccgtttttagcagttcattttttatatccctgcagtgcagaaatatggctcactccagtatctgtcctttttgtaatcgcaaaaggaaagcttggcagttgtcatatattacactcttgaggaaaatgctagtaatacgtcgaattgattgaacagcatggacccaaactgcttggcatagggctatttcctcactgctattaagattttggttaaaaaaaaaaaaaccttaccttttagattcagaaactgtgaatcattaaaaggcaatttgtagaataaagatcacatacttgaagaagcctaaaagctcccctctatttcctctctttagattttgaacgtatttccagcatgcattcacattgttgcatgctacgctgctggaaacagtgtcattggccagaagctggttgccacctgggttgtgaaatagcccaggacttcccaggctctggaggggtagaagcttaaactggtaaagaagttgagaacattgtgactgcaaaggcattaggcaaaagccatacctatatgccatccttatcattgcaaaggtgccactagaaggactatggtcttggaggaggcaagcaaagaaagaagattgatatggtttggctttgtccccacccaaatctcacctggaattgtagctcccacaattcccatgtgtcatgagacggatctggtgggaggtaattgaatcacgggaatgggtctttcccatggtattcttgtgagagtaagtttcatgagatctgatggttttataaaagggagtttccctgcacaaattctcttgtctgctgccgtgtgagacatgcctttgaccttccaccatgattgtgaggcctccccagccatgtggaactgtaggtccattgaacctcttttcccttataaattacccagccttgggtatatctttatcagcagtatgaaagcagactaatacaaagttgtattaaaagaggaattaagatgaaagtaagaaaagtcatagctccatataatcaagcctatgctctcccctgcccctcatctttggaatgaggtagtgccaactgggcctgggggacctgaaatacagggcacaggcagttccgttggaatcattcttcaggaggccaaaccatggccaccggagtcctttccgatatgaatatttgtaactaatctgaggctttctttccaacaccagctacaatagttggtgatccacctgggtttactttttaaggccactagacatgtcccccagtttctattaattttgactgcaatcaactcacctttcttctgggaattgcccttgacctctaagaacagtggtgtgctgtgtgctgataaatctctatcatccagctctccagataaaaaagggggcttatatgtagcatttgcagatttctgtggtgttaacacccctaccatggtggatttcaagtcaccaccttgatggcacccaatgtggaggtgggaatagatacacatgatgggctctgaaaggcaggataagccagctccttaaggataccactgtacaggagacaccttgcctgggaataccagggaagagatgtgcctttcagaaggtactgaaggctgcctccctagaccctaggagtgcatggcaggatgagagcactttggtgttattcacgcttaggaggtccctgtgtatgttaagctgttcttgcattgttatacagaaatagccaaggctgggtaatttataacgaaaagaggtttaagtggcttacagttctgtaggctatataagcatggcactggcatctgcttagcttctggggaagcctcggggagtttttactcatggcagaaaaagtgtcagcagacaagtcacatggcaaaagcaggaacaagagccagtaaggaagaagatgccacacatttttaaacaactggacctagtgagaactcactcacgagtacagcaccaagaggatggcactcaaccattcatgggaaatccacccccatggtccaattacctcctgccaggccctaccttcaatattggggattataattcaacatgagatttggagggcacaatatcccaactatattactgtgggatcaggctatggttggactccagttaaactatcatctttgctgaacttctccccaggcctacttcccccattccctggcagctttcacgtgagaaacttcttcagaaaattatttgcataagaattctcatctcaagctctaaacctatgcttagacagcatcagactctggaagggtgacacaacacttattttgaacagataattttgtgaaactcttattctatttgaatttgacaagctcagaataaatgacgtgagagtcaacaaacactgaattgatttctgtattcaaacctacctagcaacgatgcattaaatagcaacatactaagtataatgtgtattcattttctccatcatagtgcaagtaatgcattttgcttatactgagaatagtgaaaatagctacttggcttaaaaggaagcaagagtggcttttccttaacttaaaaaaaatagtttctgaatatttcagaggaaaatgcaaattgagaaaaatctctgctccttagatgagatgtgaaaaatattcttgataggaaggtggcagaaaatatttttaggcagatgagatgctgctagtttgataggtttctattagatataacgtaccaaactgtgtgcgtgtatacattttcacccactggtaaaaatgaaatcatgtaccttcatcttatgatattgtatgtaaatgtttcatgtgggttagagcatgcatgtttcagagctaagggccagaatggactaacatcctatcaagtgttacatctgatgaagatctgagtaaaaacacaacactaatctgttcagaacatcaggtgggcaaagataacattaacaaaataaaactctcgccttactgaatagacactgggtttgctctatgagaaaaacagatattaggctgaatggcttattttcacattatttgcagtttggattttggccctagcatactacagagcaaggaactaaaacatctaactttttaaaacgttaagaatatgagatactggaaagagatggattattttagttattcttaatctttcgtgcaacattaataaagttgtatctatatgacattaaatcttcatcagaaaaattaagtctgggagctgctcagatgttcaactgcctacgctgcatagactcctcaaattgcattatttattccagtttttcagttttaatttggttcttttgtttcagaaaccaagcttagaagaaaatgagcattttcttaagtccttcaaaaagaatctactatatttcttttcttttctgaggtagtagatatattattatttatttttattttaattttccaaccaaagatacctggtttataggcaataatatccctttaataggattcaaagtgtctgaggtttacatagaacaactttgtgggtttattcaaatggtcaggcttacaaggagtagatcgaccaatttcagagccttcttggagagaatgtacaactgataccagctttttaagatcagcatcaaaagcttatcttgggtgtgtgtgactgtttctgccgctgtccaggagatctaccagtcttacctttttaactaatgtaaaaccatttgtctcaggctgcttgacaggtggagctagtctgtaaaacttagctcatgtttttttcttttctctcccatgtttagatggatggtaagagagctgagctgcaagcagtattatgtgaataacacattttgttgcctatgtttaagaggctggttgttttgtaaaatgcctgttagttgttctctttgtttgattgttcgtttgtttttgagatggagtctcactttgtcgcccaggttggagtgcagtggcacgatctctgctcactgcaacctccacctccctggttcaagcaattctcctgcctcagcctcccgagtagctgggactacaggtgcgcaccaccacacctggctaatttttgtaattttttagtagagacggggtttcaccatattggccaggctggtcttgaactcctgaccccatgatctgcctgccttggcctgctaaagtgctgggattacaggcgtgagccactgctcctggccaaatgcctgttagttttatctgtgggattatgtaaccagaaaactaaagtggtatgatgtgatggctactgaactcatgagattcctggaaaacattctctcttgtaggaattcatctgcctataaattaattaaacatctcaagctagtccttctataatttttaataaaaattatactcagttctgggataacttgaattttctctcatttaagtaccgtcactaaaattgtacaactgtcaatctttctgtgtttagttaaaatgttccatgaaagtggagaaccaatttcactcatacagaaaagagaaggcacatgttccttggtcatatgtatacagaaccaggagaaaagaggaagtgaaaggacagggaaagaaggacagggaaagagacacagggaaatgatgaaagggagggaggaggttggagataaagactggagagaaaagaaaaggctaagagagtaaaagagatgaaaaaatgagaaaaaatgagaagaagtatagagaaataaaggaacatgatgcaggaaagaagagtaaagtcctttctaatacccacaggaggagtaaagaatgagagagaattagagacacttatgaaatactaaagccaacaaccaggtgtttccttgggagatttgcctaatgactctgcattgattttctggatgatgtcaagaggtaaacattacaaagaactgccaagacagtgagcggcaatcctcagccaagatctaaactcagcaatggtgcatgagaacctgatacccacaacagaatgcttctgcactgaatccatttcccaacttaaaatacagcatcttagactttcacattttgcttatctttcatcacttttcactgctatgcactgaaatcttccgctccctgcaaaaagctctgctctgagtataaacacaactaccttgatctcattttaaaatctgtaatcaaaatcctcttttataacattcattttgctctgaatccttcattccagctactcagagtacaatataccaaaggagagagcctgtatccaaaactttgaggaataattttgatagtggttaataagaggacaatgcaagtttcttccaatgttagtgctttaaagggtgttttcctttaggaggatttacatcctagttaaatcttcattccaggatggctgcaagcaaatatattccacacgtcccatctaaccactgctcatacagaatcaaagtacatcaaggttggaaggggattcacaggtcaagtcaaagctctcatctgatgcctcattgtgttctacaatttcaagtacccctcagtgcccatcagaactctttctgtgccacgggtctccatgaaacagaaggtcattcaattttcacatagcttgaattcttattttgaattgaagtctggccaaagttactttcaaacagcagagctagttctcccctatgtctgagcctgcacagaaaaggtacatttaaaatcagctgtaatgacttcttaaaatattttcctttccaatagatgcatagacagagaaaactgaatataaaacattttgatttttcattactttcttcctcttcttctgtactttactgtgtcaatgtgttttctattagttaaccttactgtcagcactaggggaactgatgctaacattccagatactgtcttctcagtgaagggtattgcatgacaatggcctcacttgtcatggatgtagaacctcaggtactgtgtaattagactgaattcatctcttggcatttcccctgtgctatttactcaactgagcatattattcattaacttcctgtactttttcacatgtagtgttcttacagaatatgttgctcggcctgaatctgtgacattttatgtaaatatagtttgagaggaaagttttatctttatgccttttgggtttggggtactagcgaggtggctctgaattcttcttctgtcttccatagagttgaaatcacttcacctctctctacatatgctatgaattctaatgcaaacattagtttctctgacaaagaaattcaactgggagttatgttttcttgctgaaaacaaaaacacctgtgatggtagctaacagcatgttcttctctgccagtcattggcttgataacttgcattattacctgcctactaagtgcattttttcatataattctctccaccaccaccctgcaaggaaggtagaatgatgatgctccttttacaaatgaggaaactgaagcttagagaagttaagccaaataaaccctttgtttagtaatcaaagataatcttggttcattttgaatcaaccagcaccttctcacatttatctacgatagtgctggctagacagtagcaatctaaaattcaaactcagttctcacatctggtcatccatggccatgtattctctcccaaatggaggtatacattgtcttgcttatcctgctttcctctaaccacaactttttaaagtgctcctcattttctggaaacttcaacttgtcctgggcttgattctctgtgaaaccattgacaaatgatttctcctctggtcctccttggctctaagccctttctcctgcatctctacatgccatttaacaatattatttctcataaaattccccgtgctgccacttcgatatctttagctcctgccagttcctttttcggtactatcgtttgtgattctatcaccataatcttatttttaagagcttcccaatccactagagccatcttccatgaagcaatgagatcacatcaattttaatcatgatattttaaaaatctgccttttgaagttttcatatccatgtctgacaatgcctagctttttttctttttttaaccttgctaccattatttctaagataacacacctactttttcctagagttactgtccactccacatcactaagcctttccttgttggttagaattaaataaccagacccctatcactttctcctggaaaggatataattgatatgtcaataaaggaatttgtctaaccacaaaatacagatgagtaagaattgcatccacttcttcagcagctcttaaagatctgctgtatcccacaaacatacataaaattatacataccattttcatatcagagtttcagtgtaaaaagacctttggtgcttaaagacagctattgagttttaaatgggtaaggatacttatccaggaaaatttaacatcagttatccaataaaaaccagcaccacggcaacacatttagatgacaaaattgatcgacctttttgttttctttccaccttctgcatatagagtaagatcatctgacatttaagatcctcctgcaagttacatttctttctatctcccttttcatgctagctcatatcctacctcttccataaagtcttgtttgacaaacccaacttctcactctattaaaacattaatgccaagatgattgatttgctaattaatcatttcttaatatctataccgctattatctcaaatagttatttaaatcagttactgccatttagcttctgtgtgtctatattttctccccaaatatatcgtaaattttttgaaggaacataaaagcctcaaacataagaggtttcagaacatagcaatgtggacatgccgtgaatggcaatgattaaattttgcaatcaggttcagaggaaaattttaaaatagagaagtgataagattttaaataccaaaccaattcacatttcttattttttcaacttattttaatagtcataaaaaacataactgaaaattagttttagtaacagattctgtggatagcaaagttcttttccccatgggccttctcacattccccccaccttggatcgtagcaacttttggtgaattccacctaaacgcatttcttggtaagcaagggtactcttggttccattcaaatcagtcagcgctgtcatggataaccccaaggatataaaatgaaaatatgaaagcatgtttatcataaggagctcttaatctaagggctaatatctatagtatatttgtcttactattccttacaaggaaagcgatattaatattacaggccaaggttcagatcctaaaataaatataagtaaggtgcttaagaagccaaataaagagagatttcacagttagctaaagagatcaagaggaatttaagagatagtattggagccacagaggttaaaagcaggggttcggactccttaggcaagtggggtgaagggtatattgtggccaaagcacagatcccaggaaaaggagagatgcattcactttgtttgttttgtttgtttgttttttaaagtttacactctcactgggaacaaaaggtatgtacgaagtataatgcaaatgtctgtggaaaggagatttggtgctgtattacaagggctgtgaatgccaggctgaagcatttatacctgatttataagcaattaagagttttattagctcgtatttatttcatgggaaatgtggaaacttccatgtagatacacctatagctttgtgttggatgtcttccgatcgtccatttggatccatctttaccttgcttaggggcttggaggctggcttgcatggactgattcaacaagctcctttggcttctgccttctttccataagaggggaggaaaggagtgcagtcagagccttgttccccagctccacccttaggggttgccctgagctggttgcttccctcactgaaggtcaggtgttcctctccatggttggttcatttggtctccaggttctggtcctcactccctctcctcaccccttccagacctggggtggttataaacggtccctctatgagggatcctcatgactcaacatgttccatgtctcttgctgagactctccctgatataatccccaggtatccagaaatcaaaaggaaattggcgacaacagtagttttagcctttgctgggcaaaatttcaaacaaaaaacctgaagatatggggaaaaatcagcttctttgagataaccaatgtaggtcttcagtctgctgatggccagcttcttctcttttttgcttctctctctttctctgtctctctttttaaagatggggtcttattatgttgctcaggctggtcttgaactcctggcttcaagtgatcctcttgctttaagccttctggggagctgggattgcaggtgcaagccactgcaccctgcttctttttacttcttatattcctgactgtgccattaggctaaggtcaattatttctacaacctatctccttctcagaggtttcaagatcttctaccctctgtatcaggaacaggttgtattccaaaaacttgtactggatgtctgtgaaagtctgccaattcattagggaaatgtaaatcaaaatcacagtgagagatcacttcacaaccattaggatggctatttcaaaataaataacaaaaaaaaaaaaacaacaagtttctgtgaggatatggaaagattggaatccttgtgtgttgctgatgagaatgtaaaatagtatagccactgtgtaaaaaagtgtgacaaacctcaaaaagttaaacatagatatgccccagtaattccactccttgccatacacccagaaaaactggaagcagggactcaaacagttcattgtataccaattttcattgcagccttattcacaataatcaaaagctggatgcaacccaaatgtctatcgacagaagaacagacaaacaaaatgtggtatatacatacaatggagtattattcagccttaaaaatgaattaaattttgatacatgctccaacatggatggaccttgaaaacattatgctcagtgaaataagccagacataaaaaagataaatattatgtaattctacttatatgaggtacctagagcaggcaaattcatagaaacagaacgtaggacagaggttaccaggggctgagggggatggaaaatggggagttcttgtttactgggtacagagtttcaagttgggatgataaaaaagttacaaaaatgcatagttgtgatgactgcacaatagcctgaatgtactcaatgtcactgaaccatccactttaaaatggttaaagaaaaaatggctgtcaaatattctgcagcagagaccaaacacaggacccatatgaagaactatcggtagttaagaactcctagaaatgacaagatgatactgagagtggagaggaacttagaccccacagcattggactggaagtgtcaggagctggcttccaaaggtgctctcacaaatctaagctgctatgaatctgtgattagattcatttttattgtttccctgttgtacaggaaaaaggctgtttctgactataattttacaaaaatgccaaaaagttttaaaaataatttgttgatttgtggttagtaaaccagtataatctttatgttcacatctattattttagattccttttggcactgcaacaaattaccccataattagtggctcaagtgaactcaaatttattatcttatatttggggagttagaaatctgaaatcagttttgctgggctaaaattaaagtgtcagtagggctgtattccttctggaagctccaaggaagaatctgtttctttgcgctttgcagcttccagaggcctccttggctcatggccctgtgtcactccgacctctgcttccatcctcacgtctctgttctgattcggactctcctgcttctgtcttttccttttaaggactctatggttacaaggggtttgcctggatagtccagggtaaccttccagttttaaaatcctatatttaatcatatcttcaagataccttctgctatgtaaagtgacacatttagaagtcctgtggattaagatgtggacatttttggaaggggacattattctgtctaccacatttatcaactccaaatatattttcaaatgaaatggaaagagaggttagaacatacgtatttttcagattaccaaattaatgcaagtctgttttagcaaatctagaaactttagaaaagaaaaaataaaacagtattatccttcatcccagtctcttttttagatcctaccttctatacttaacatatgataaggatttgtcgtgtcatcaactaccttttatacttagatcctacttcttatacttaacatatgatcctaccttttatacttaatatatgataattatgtttagatcctaccttttatacctaacatatgacagatcctactttttatacttaacatatgataagcaattgtcatgtccttaactactgaggtgtctattttattaaatgagttaaaagatgagaaaagatgacggaactgagttttggttaaaatgatagaatcggcaagtgggttttagtctcagttttaatatgttttttctccttttagatattttagatcagcagataggtttctatgtgccatatttccttcctgaaagctaaactcacgacctttcaatacccacctatatcaaatcctcaaagcaaatatctatattccaaaataattgattgaagttatccatattttactctgcggtaaccttctcatcctgtatttcattttcaaattaccaagaatctcacttatgtgactatacactaaaattaaaacacaaacacactgcgtacactcactttggtctgagcaaaaagacatgaaaggtgaacatttttgtgaaattttacaagttcaatggctaacaagggtctcaatctttaaaacagtcagtgaggcttaactcagtgtaaaacatcatttatatcataatcaaacttcttcatatatggaaactttaagcaacctgaaaccacaaagaattatctccccaacctcctctttttgattaagttaatttagtagctttaactagaatggattaattagctccaaacaatgtagcaattggatgttaaatttaacagggtcaaagggtggagattggttccaaggtaggagtcttatatctacatacaacccagccttaagggcgtgccatttgtaaaaatacaattacagatttaatattcattatgcaaaatgtttgggatcataagtgcttcaaattttactaattttggatacttgcatatatctaatgagatttattggggatgggatccaagtcgaaacaaaaaattcatgtatgtttcatatacattatgtcttatgtagatagcctgaaggtaattatatacaatattttaaataactttttgcatgaaacacagtttgaactgcattttgactgcaacctgtcacatgaggctaaaaggtgaaataaatctcatttttaaataaaaatgaatattttctattacactcaaggcacagtgcataggatgagaaggaataactattattccttgctattcttgtactgaggttgaattttagccttaaactatggtaaggaaagcccttgttccttcatttgagcccaatgtcaggtcaaatatgttaaaataaacatagtaacgcaagtcaggggcttccagagagctgcatcacagttttgtgcataagatacacttgaacaccagaaagaataatgcttgtggataaaaatgcgacacaaaacatgtagttactaggctgcatttcacgtactgacacccagcttggctcagacttcaaaatgtgacatcttgcccaaattcaacaaaacttcccagtcttacagggtgattttcaaatcgattaagttgggtatttctttaagggaaaacaaaaatcagagcagtgatttgaattctcactttcaaaacaagtttccaactcattaaacatcaccttcaaaatgtgatacaaacatgatttacctattgcctagcaaattaaggcatttcattaccaattagtttatcacgaccaactatattttattttctacctttcacaaatgcaaaaggaaccatcagacagttctcagctcttcaaaccactgacaacaaaaattgtgccagatataaatatttacatcatgaaaagtaaatgttgccaagattccaaactccaatgcatttgaaaattggtttggatcaggtatactttcctgaattggaaagatacaaaatcatctgttcaaaaaatatctctaaaacaaaaaaaaacccaagtcataacatgtgagtgatttttaacactagactatctcccaatctcttctttcccaataaattttagggagaagctgtgttgacatttttttctttcacatcaacatttttcctttaagacattctgatggaaagtaaaaattatatatccattgtttgtgttagtttgacacattttccatctcaatcccaatctgtactttatctaaaaccccttcaaatgcttgccataactcgtaggcgaaggattcagctcccgaacactgcctcaggacctgccctctgctgtcctctctagcctaccatcttgcaagcctctcttcgctccctgtgttcagccttgctggctacctttcagctgcattctggaactcaggcaccaaaccccattctgtatcttgggcttttccaccccctgcttttccttttgcctagaatgcaattatcccctacatcaccctctccaagaaagaaagaatgactgaatatttaatcataactacaacttttccttcttaaatactgaccagcgaactcacacgtgttcacgactttaaataaataattcacctttttaaagagaaatgtacttagaagccatgacaagctccttgcagaatttataaaaataaaactataaatggaacaataattaggatagcatcgttttatatggaatcagagcaataaactaaatgacctatatatgacctttccacaaaaatgcttctcaagtcatatttaaaacagtacacaaatactgcataactaaatggtgtcgaccacatgcaatgtcttttaaaacctgctttgtgacctgagtcaaagtcacttacagctttttgatgagtcattaggggtgtgtgtatctgtgacagttacatggtacaagaaaatatatttcaatacatcagaaggggaaaaagttaacttacaaacttcatggtatttatggtgaacagactgcacaaaggaagagagaacagagcccaatgacccaaaccctgaagaatcagccgctggtattatcaaaagttgtcaataattttaacctcaattttttgcacacaaattattttccatttctcttaacaatagctaaattacctttgaacacaattttctgcatgtgcattttttttttacctttaacaacctactcaacagtaaaagatagccaagtagacatgaaccagcaagagaagtgctaagattccagtgatgagaagacccaatgggcacttgtgcccttccacaaattaaagaggagctcgttatggggggaggagagtgaaggagggatttaggtgtgagaatcacaaagcccagctcagcatttctgtgcaggagctaggattcttagcaagcaagatgcccctaggaagattaattattgattttcttataaatcatctaaggtgatttttgtctgtttttttcctcccaagatgatgaacgtctgattttatttttgttaattggttttctcacttcactgaggttaaaagaaggcctagtaaagcagtttcttagaggaaagattttcccagcatgataggcaggggtggccactatgctttctgtcctttatgggggtaccaaggttgtctgataagacttcaggcaacctccaggaggtacagagtaatcagaagcacaaaagtttgactagttagggagaaaaagcacaatttagacatatttctatctaatggcggcaggtctgaagtctgtggtattcctaggtgggaggacaaactcatcacagagactgaagccttgaggattagctttcagaatcaagatggccccatcttcaactttaccatggaagcaatatggtggcttaccttcctgccccccgtgttgatgcgaagaggtgtcagaaaggggtcgaagatcatgtgactggtctctatgttgactggcgactgccgtttccccacagagcaaagattccaagctgagttcaccaatccccagaaagaaggaactagaaacaaaaagaaattatagaattaggctgagtagcaggttggggaaacaacataaataaacagagctatgtacaaacgtggtaaaatggaagagaaccaccaaatgttcccacccatggagatccttgggggttgctatggtattttcctggtctgaatcttggtccacttctctaagtcttacctgcatggtctcttgtcatcagattttcttgtttgaggcccactcatcctgcagtttctttgttgactgcagtcatcattaacactttaatgctaacatcattgttcaggtctcatcatctttgcaatatgcctggggtagcacaaatatttagcaattccctggagttgatgctgtgcttttcctatctggcaagaacgatgtgaaaatcaaccttatcctatttggaagtttttcaaggaaagtgtcattcagtgtacacaaagtttttctttgggttgtcaagactaaactgagggagtgacttattttatgagccccctaatcaatgccagacaagagcttagcaacttgacttcatctttgtttagttcaacactgtgtcattaacctaatgtacttgtagataaagaattggtgttcatttgataggcagaaaaatgacattaagagctgagcacaaatacccaaaggaaaccgtccactcattttcagtgtcacatgaaaacttctattagaatgtatttctgtggcaatttccagttcgatttctctctatttaagaaagttttcagggcaagggtggggagccaacctactaattttatatcagtgaagatcaaaactatactttcagcctttccctgcccctttcagtacttccatcgagtctctggatccatgtgtccttcagattcccctgagattatatggccattcattcatccacccatagtacatgcagtgaactcctatttggcatcacgcactgggttaggctgaatctcgaggaaggcaggtaagcacaagaacaactaacacactggggaggctcactagtgtgaggtcgagtatgttatgagactccggatgaggggaagccaatcctgccatggtagaggggaggcagggagtgactcctggagaagatgagcctaacaatcacattagccttcttaaatggacctgtcctctcagaaactcaagtttaattaaacttaaattgaataaaggctttaacttacagtagccatcattcttgcctatagcatagatggagaaaactaaggcaaaagaggagtttggagacacttgccaaagatactcaaattctttgactctcttatttgttataggcaactgtaacagacatgggaggagaactaaaaataagttccttggcctagacaaacacttcaacatcaaaataagatgggtctcattttaaaatatgacaaatatctaatttggtttcatccatgccaataagcctctggtagaccatttcctttagtttaaggagtttgaattggctttttagtcattaatgactttcaaaatggtagcaatggcctgagttacagagggagaaagaggaggaggaggaagaggagaaacattgacacatgtgcatgggcttcctcggccctctcatttcttatcatttcttaaaatatgttatcactacaagttactccacctttagaaggtaccacgtcctagcaagactacaatatttaagaaagttcttgcattatgaatgcacttatattataaatataaacttgtcttttctaaactacttttttttaaaaaaaacactgacttgatcttatatttatttatccctcaatcatctcaaattatgaaaataaagccttcattagggcatcctcctagcagtctttgtccgtaacgcacacacaagtggcaaatgtgagcatgccagggatatagtcatggcacctccacaagtgaactgagtggcccttggtaagtcatgtgtcccttggaccttcttcatggttcctgtggtaggccgaatggctctccaccaatgatgtttactatcctaatcctcagaacatgtgaatatgctatcttagatggtaaagggtattttgcagatgtaattaagttaatcgttttgggatggagagattatctaggattatctgggtgggcccaatgtaatcacagaagtctttataagagaaatgtaggagggtcagagatataaagatatacagatggaaacagaggtcagccaggagagaagataatactctgctggctttgaagatggaggaaggggacatgaaccaaggaatgcaggtggcctctagaagctggaagaggcaagacaatggattctccacctagagcttcctgctgtaaggaatataggcctgctgataccatgatgtttaaccccttgagaatatatttgacctccagaaacgtaggataataaatttctgctgttttaagccatgcagttgtgatcatttgttatggcagtaacggaaaagtaatacagcacccctttacctttaaaactctgtgagacaataacctctttgacaatgaagacatctatgatgcttgcagggctctccctagaaggcagctgcatgattaaagtagttacagctggtgcacattgcatttcatctactcccatgaaaagcattaacaaaaataattccaagcccataaatggattataagactgctattatgtggcaacatgggtgggcagctgctgctgtacttcactaataaacgtcatgcccaaaaagtacccccgcaaaaacacaaacaggaaaaactttatgcgaacatctgccttctcttttattgggcatggaattctttatgacgaacagtttcggggttttatatccccacttcacgatcaaagcctgcgtctctgatgctaatcacctgctcagccaatcgaggaagaagtgagaaacctctctcctgctcagctgtgtccctcattggctccagccctgaactgctatctaagtttatttacccctggatggctgattttaaatcagctatgaattaatagcttttcagaaatagaagccaccttagagatcgtctgacttaaattcattacatggatttaaggccatagaggcagggagtaaagtcctccactctaggtcacacagccaggtagaggcgaggaaggacagagtaaagaacattactcaagatttccagtgctactgagcctctgctgctctaaaccccttcctctccagcaggctctatacatgagcagatcattttaggaaatttcagttaattgctgccaagacccctgtaagacttttgctatcatttctcttttggtaaatcaagaataacattagtgccaattttccagttaaaataaatttcaagtgcaaaggtttgaatcaaactgctttgaaagtcaactattctaaataaacttaggattttaaaggagccatacaaccatggagtaacatacatagaagggcctgggtgtgaaaagacttcagttcaggcgatgtgtttgggtcccatctgcaggcctctgaggagacctgatggggatgattgcacacaaagagctgctccagggatagttcctggggtcagctgcaccgggcaaggttttagtgcagataaaaatgagaagtcagtgctgttaggagcggtgttaagtgttgggacaataattaagatattgaagctagtctagggaactcaagtgccgaatggaccagactaggtctgcaaatgtggtgtaatctagattctagggaaatggtttaggacgaaggctgtgaaaacaggcgtccatgaagtgcctgtgcctactggggcatgggagtcagatggcccactttacatgcagagcaaggatgggcgtatgaatgaaagcttcaagatttagagtgagaaacttgccctgtgggtttgtgcagaactgtcagttatatccaaggttctgatacttaactacccttcatctacccttcatagtgttatctttcaggtttatagacacccgtgtcaccttttggagcaaaagtgggttatataatgctgtggcaggcactgcctctatttccaaggtaagagaaatattgttgaatttttttctcttagtttccatggctatcctccaaaatcagatgtttaaacttttatttttaaagcatccattattatggcttattagctaatgctgtgtctttacttgatcaatacaacttactgttgagagaaaatgtaaataaagcaaaatagagtaagaatcactctaattaatggacaaccagtctgacgatgtttgaattccatcatccttggcatcctttttgtacaatcttctaatttacatataaactagaacacaaaacagacccaaatatttttgcaaattaattttcacacagcctaaaccatggaacttaactgctgcatcacagcgatgtgttatcttgccaaagtatttcccaatggcactactgccattcttaccataaattacaaatcccaaacgttctcttggctctgggtccagtgagttttgaaagatgctcagtgactctgtgatttcaactgcttaaatcatgagccttggcaaacccaaagcaaaacttatcagctgcttgttcagacccatgaaataaaaaagctccagctgtttaataacacaccttggcaacgtctggacaaaaacaacaaagttttcaccaaaaacaaataggtcagaagagcaaggaaccagaggaatcaagtccgataaggagagttaaaactggccttgacttctttgtcctagagaaggtgttccgaagttagattgtgcttttaggcatcttccttattcatttgtcctaagccagcagaatttgctgctgtgggcaggatattaggcacttggaataagtttatacagcttatgtgaatttgctaagtcctatggcaacaagataaattcaattcaaaagcatttactgacagcctctgatgtgccaggcattagggttggcactgaaagttgatgcaacaaatctttactgaggacctactatgtgtcaggcactgccatcagttctgggaagtcaattatgaatgagagatatggttcctattctcatgaatcttgcaggctagtgggaaatatgggagataaacaagtttctatatgtctatctgtgtaaagtttttggtaagcatgttgtagagacaagacggtaatggatcatagcttaaagcatgtatgggagagaaaacctaggtagcatggtcaagggtggtctctctggaagggtcagctggtagactctggaaggactgggaaagttgcttctaaacagtggcaggagaaaggatgtccaaggcagagcgaaagtgagcagtcttggcagagaagagctggatgtgttcaggaacagagaggaagtcagtcgacttgagcctgatggaccagatgaggagaagagcgaaatgagatgggggctggctgggtagaccaggaacagatggctcagtgctctgcaggccacactaaggagtttgcattttactccaagttaatagaaagccactgagagtttagcagggaaataccatggtctgattttttaattaaaggcaggtatctgcctcagatggaacacagccaagagcaagctcgactatccttgaagtagtttgaatgggaaaagaattggttcccaagcaacagttggggacataggtttttaagtgaatttaatcctattgcttttggtgtgtttaaattctatttcaaaggcagaactaattgaatgttttaaaattattctcttcaaaatatgtgccaataaaatcgtgttttcctaggaactagtgctttacaagccattctttgaagcaaggaatattttcatgaagacactcagctaaagcaatcttttctcgttttcaagcaataaactaagtcccctactttttggtcaagggaaagcaaatgaaagttgggaaaatgaacgctggcataaaacatatctctagtgaattcaatcctacagataaagccttccacttcaatatagcaatctctactttggggttataaagcatatgaatacattttaaataagaactcatatctttcccttgctcttttcctcaccaatcctgatttactgtctcttcctctcttctcaactgtaataaatctccactttgagccattattaatgagcaagtttaaaatacccactgctgcaggcttttggtctgtttctgatttgatttatttcatagatggaattggccttaaagttaacccctttgctgatgatttcttcctccattgcagggcctctgactcatagcacatggagggtctttaactagggctgcccattgttaaaggtaagttctcccattgagaactagggctgtcacttgggaacctctaaggaattgcatatatcctatttaacccataatcattaatttgtgcattcatctaaaaaattaatggactgtatctgatgaaccagggatagaaagataaatcaaaatgctcccactcttcaggacactcagtatggtgggaagatagacaagctaacaaatagttataacaaaatatgatagatgttataataagggtatgtgtatattaaggcttaaattaattcagagcaagaagcaagctgacctggcccttttctcaagtgctaaggtaagccttactcatagagagtgcattattttaatcctattgctttaggtgtgtttttagtcttgtaactagttaaaacattgaatcatctcctcaaacagagatatactagtcctaacaactaagatggattatcaccggaatgccaactattatacagggaaaatttaagccactgcatcttccatcttctcacttctccaatatttctcccatacagctattattccatggggaaaagatcattagtaccatgtccttaccacagaaccatcagaaggtggctaaattactaggtggcttcatttctctagctgtaaaaatgggggtgacagctacttcacagagctgttgggaagattgtgagaatgtatttataaatggtctagcataatgttggctctataataaggatttaaaacattggagaaggggttgagtgaggagggggaacagcatgaaccacagtgtgattccaacactgtagcattctcagggcagaaacagtcgagggtgaaggatccaggcagaagggtacagggaggcaactttcagatgcccacccaacccagcctggtttcagaacagggcactctgatgggagtctaggtcaagggattaattgcttaattccatactttcaatgagccatgtgcatttatttcttggatccataggtctcaatgtctggataaatgaaggcagtgagcagtgatatgggtcatccaatagggtttttaactccaaagaaaaatcattttaatgtagcttttgggagttgtcagattacttatttgtgcagcagcagcttcgtccttcttcctgtttgtacttggttccaagtggtgactggctggatccccaaaagcacatcactaaaggtaaagagaaaggaggaagagggaattctcttttgctgatcaccccctgtttaacaagctctgtgctaggaacttgacacatcttatcttgctcaatcctcctcattattattattttacaggtgaggaaaataatactcaaagaggttaaatgactttctaaggtcacctggccagtaggttagggaactagaatttgagatcagtttctttctttaaaacaaacaaagaaaaaaaccaaaggaagtaatgtatgtatggtaacaggtcaaatgatccacaggtgtataaagcaagaggtaatcatctcttcctccttccagtaacatcctgaggaaaccagtgtgaaagtgtattaggcatcattcaacatctttcagtatactcctacaaacatacatacaaatatatacacatgtatatatatatttgagaggttcttttctaaaaaagaagtatttttataaaaagtaacattatgccatggatgtccctccatgtccatactaatagagcttctctttcttgtgtaaagctacagaacttctacagtttgaatgcacttcacttttctcaatcattccctagatgaaagacattacagttatttccatcttactttaccatgaaaatcaatgctgcaataaatagcctcagagatattctttttcatactggtgctttcatttcagtagaaaagattcctaaaggtagtattgttcagtcaaggtaggcacatgctttattttaatagatgctgtcaaattagtttcaaagatactggtagtgactatgatgaacatttactctcctatcggcaatgtgtgatgcatccatttccccaaaatctccatagtattggatgttatttattatttatttttagcaatctacaggaagaaatggtatctcactgattgaatttgcattttctagctactagaaatatttctagtatattctcatatgctcattgattatttgcatttctcttctgatcgtattcttcacatatttttctctgggttatttatgtttttcatttcaacttcagctgtcatgtgaattatggagatattaaccttttgtgacatggtataaatattttcttatagcctcttatctagcttttaaaccttgtttttgatattttgctatataaggattttaccattttgtatggttggatttgttgataattttctttataaggtttctgggttttctctctcatttaagatggcctttccaactacaggttatatacgtgtttttcttacatttttataaaatatttttattgttatactttttacaacttgattatttaaaaatataccagtgattaatatttgtatatgctatgagacaggggtctaatattttttccctgataaaaagtgaataatgccagcattatttattaaacaaaccatctttcaccatcaaactgaacgcccctttgatcacagattaagtttccatatgtattggatttgcttctggtctttctagattgtttcacctatttgtgtattcttgtgtaagtgtcatactgttttgagtgtagtaacatttatggtaatttatacgacaaaacttccttcctgatcaaaaagatgctgctcttcccctgctaccactacgggaccgtaaacacccaagctccacggaaatctggagttaggactagtgatcctaggaacccttaagctgttggaccattcttgggggcacaagactgtcagaggttatctggctcctcctcatgtcttcaggtagttaggtacttcagtcatacttgatagaggacagtgtctgcccctttcctcaaaaagccctcaaggggaaatttgctcttttaatcaccttggaagtagactttattatcgccctgattctcaccagtcttaatggaatctgagacatagagacgtcaaactaacttgttcaagataaacaaaaaaaaaaaaaacaccctggcaagtggtgaggtcaaaattcaaaactcaggttgttctggctccagattccttgtgttcttataactcctgtgctatacttcctccctaacctggtgccctgacttaagccaaacatgttttcttctgagcctcagtctcctcctttgtaaaatcagggtcataagaggacacactttgctgaatatctttgtccaccaaagtgatagtgaaaaatcaaaacaataaaattagcaatgatcatcatagccaattctttttattcaccaagtcatggagtatgccattggtgggaaatcagaaagaaggtagatttacatcaaattctacataattgcagtccccaaagatgggtactagttttcccattttacagataggaaactgaggctcaaagagttgagtaatttatccaaggttattcagccagtgcacagctgagctggtgatttgaacccaggtctaaaattcccactcttattctgctctcattcatccctcagacctagcacagaattaagatgaattaagctgccattatggtttcctcctcaatattttgctttctgagaattaagcctcctgaatcaggtgactcattcttgcgagaatccacaggaaggcataaaagacagtctggttgacgtaggcattaagctcttgtgtgcctgtatcaggtttaagatttagtctaacagttgtattaagcattatcaggttacatttggctagcaatttttcttgccccatgtaattacaggtgcttcagataaaatctgaaattagttgatagaaactgggaattaaaaccacaaagagaggaatgtctcaatgcatgtcaataaaccagcccattaattatttctacctactcaactctgaagaaaacgaccaggctgatgcctctggataatcacatgacctacttgatgtttatacaaaagctgaatcttcttggctttcagaagcaaataccagtaatgttgaaaccagcagggacacaagaattaaatgccagaaaaaaataatatgaccactgaaaataggtgatcttcttcagcctttgtaaattctgaaagttcaccaaaacagtatcaggtgatgatttcccacaaattcaaacatctggtgaagcacttctaaaatcctgcaaaacatctggatatcatggaatacatatgtatgtatgtatatgtttagtatgtaaacatctcactgtccctctatccctttaacactcactctctctgtacgtacatgcaaaattatacccttacacacatggcaaaagtaggtgaataatgaagggtacagtagaattgcaaaccctaccacatattaataactgtatatggagatcagttgaacttagccttacagcccattgcagcagtggatacctcagtttttgcaatttctcattgtcttcacatttgtgtaattctatagaaacctccagctgttccagtctgtcttgaggtttatgtgtatgtagggtattttctttattatttacacaaataacagggcttagttatcttcatgagacatcaggagaaataatcttcatgctgccactgagtcttggaacccaaacacaacacaactggtcaccaaagatggaacgaaaccacatatataatccgttggtgttttaatgattttgcactaggattcattgtccaataaatgtgcaatgtattttttatcgaggtgctagattttgcttctatgatatagtgtcttgaccaacacatttcacttgtcctcttaactttcctgttagacttttgtataattacacttcctattagccaggaaggaaatcttgcaggcattatatatatatatatatctgtcatctcccaaatcttaccatgatcaaatctgggtgatagctttgaatgctttgaatattgaacctagctactagtagcctaatgcaggttcccactgccaggtgccttagtttttactacagtatcttactaaagttcccttttacaaatgacatgagagcttggcagacaaggaagaaccaggactaaaaattgggctaggtccatggtccacaacagaatttagtgcacagcaatgtaaggatgatgttactctagacctgtgttcccttgcagccctggagttctgatttgatgctaccaccatgttgccagtttccattccaatacttgacacaatgtagatactcaacaactacttattgagtgggtggatggatgcatggatggatgcatgagagagggcaggaccaagtgtctgctttgcataccattttctctcccgtccttgtcatactatgatcttacaatataatttgtagaatgagtggagaattattctacttcatttcaatacccccaataacacaatatgctcatgcttacttttgtgcttttgctttaattattctttccactttctacaccccatagtcaaattctatacctcttagcacccctaatttaaatactaatccctccattaagtcatcctttactattgaaatcatcactctggatttctagagaagctggttaggtgctagaggattcctacttaattatgcatggctatattgttcattgtcttaaaaatgcatttcctaaatagatgcaagttcttcaagatcaggaactctgatatggcacaagacctaattacagggcctgggcctataaaaggtgactgaccaaaagtaaatatctctaaagggtttttaaagaaaatctcttgtattcaaaatgactctagcaggaaaatagatttagtgaatttctggcactcctcaacaccttgtacccaaatgtatgcccagcctttcggggctcctggcagttccaccaacaagcctttgcctgcagtggctgcactgcctggagcatccttccttactttcctatgcatggagtgcttgttgcaagcatgatctgggactcaaaccagagactctgattaaataagtctatggcgggatccagagatttgcattatttaacaagcagcccagctacttcccatgcaattgtccataggtcatgataataggagaaaccagctgatgaaattaacatttattggaagaaagcaggtttttctcagctttacaaggtcagcaacatgaccttaacaatgacaggcctaaagggaaaaacacatcgactaaagggtcaataagaaagtatggaacagagaaacaaacattcaaatgttgcctcctgccctgccccttgagagagttacagaacagtatctcctggtggggttagtaaaatttcactgggacccaccattgctctcaattttctccaccttttgttctaattcttcgtccaccaaacaacctttggatagaggttaccaagtgttctaatcccaagaaagaaaaagaatgtcttagatggcagacatgaatagttctgttatagaaaggggatttcccaattcccacattttaaaatgaacggtcataatggcttattcaccatcctgtgctattttaatgatcaccagtcaggcctaaggtccaaatcagtgaatataccaggactatcctgtttctggaattaagaatatgtttatcagacatggggccatgaagttttaaccggtatgtggcctccaacaggcactgccagcaaccagaccctgcccctcaatggcctacctctgcaggctaccctcaccttatgggaagagagtctgcaacttatcatcacgtaagaaacaataagctgcatttaaaaaccaaaaatgatttgtgcacaaagacattaacaagaacataatttatcataatgaaacactgaaaacaatctaaatgtgcaacaataataggggaacggtttagtaaattaggtatactcacataaagaatattggtgccatcattaacataaattttaacaatacagcaaatttttatatatagtctcaaatatataaaacaatgtgcactggagggacaaaaaaataaccaaaatgtggatagatgttatctctggatagtgaaattacaggtgaatattaacatacatgtatattccaagctatttacaatgaggaggtagtactttcagagttaaaacatttgaaaaataagactgcttatttgggccagattttaacactacagagaattatattctgttaaactgattaattttcttatcacatctcttttcattagcaaggaaatgataaagagactctacttctctgcacccactttccgaatttctgggtcaactgggatgatccgggtagacccaggaataacatgcaggtggtacaccctccccttgtaggaaaggagagaaagggcagtcacacttagcagttgtcagaaagaagacctgggagacttctctatatcaagcaagaattcctccttttcatccctgcccttggacaagagaagctaatagggatttagttaattggctggttttcatcctaattggctgatgaatccattccaatctcaagaaaaattgcagaggaagaaacaaatgagggctcagctgccaattgatgttttagagacggcattttatgtgtcatgaggtctgaggtcctggagctcagagtattagctttccgggagactggggctccatcaagggtggggtaaatatccttgctgggagaccacaggctttcctgtctcattgaagaaaaaccgaaaacgatggcacacattcgattttgtcatctaatgctaaattcagattaaatcaacacggactcgttctggggtagggacagaaaactccagggggctgaggctcttgcattatgtgggccttctgaaggtgccaggtaagccgatgtcagctgagtttgctcctacttttcccacatcagtcagttctaccacttaacagggggattagtaatctcatttcttgggactgtcatcaaagtatcagaataaaaccacttagtagagctagccttctgcaaaatgttgaggtgggctaaattggtcttccacaccttgtcacctgccttttaagcctccttcccctcgactcccttatcaggtaggctatttccatttctcactccctttcagtctagctctcctgctccccatgcaagattacacctctcacagtcacacagtctgaactgctcattggtacttacgatcagatataaacaaaaacacacttaggaaaggtgggaatgatgatagaaatttgtgctagctaagaaattcaggccagatgagggctatgaccaaaccatcctaaaaagatcacaggaaatcttgtcatttgggacaacatggatgaacctggggggcggcttattaactaagccaggccccgaaaacaaatactgcattatctcacttacacgtggattctaaaatagttgaactcacagaagcagagaacagaatggtagttaccagggctgggacaagaggagcaattggggagatgttagtcaaaggatataaaatttcagttaagtggaataagttccagaaatctattttattaacatggtaattacagttaaaaacaatgcattgtctacttggaaagtgctaagaacagattttaagtgttttcaccacaaaaaaataagtgtgtgaggtaagacgtatgttaattaacttgatttagtttaactacttcaatctactgatcagatgcttgtagtatctctggggattaagaacactcaatggctcctcattgccactggtgcactgaacctcctttagtctggctttgactgccctttgctgtctggcagcaatccatcccgtgggacctgttttctgtggctcctcatcttggcctctggctggatgagagtctgacatttccagtgtgtcctggtgctttcctttctccatcacaccatgtccctcacctggcatgcctactcattcaaatcttactcattttccaaggctggactcaagtattgcttcctttgaggattttcctcaatgctccttacattaagtgatactttcttcttcctctaaaattctgttttatccaatgtctctgccatttgtaacatgtcttataacaatagcagaaagcatgtttttgcgtcttaataatccttgtagcttatagtatgataatgaaatatacgttgtttgatgaatgaatgaggagtgaatttttaaggtatcctgggcataaattctgagtgaatgctaccacaccacacagctggacctttctcttattcttgtttacttgctctggctctcatatattcgcacatttctgtcagcacaattagggtatctaaattgaaaaataaaatattgataagcagagagaaaaacagtaaaaacaaaaatatgatgaatgcttccattgtctcagaaatgacagacctttttctacttggcctttataatgtaattatttaagtatttctgtatgtagaatccaccttgctctttagaggccctcaggcactttttacaatgcaacatcttgattttggaatgcatcttcatgtgcaaaaaaaaaaaaaaaaaaaaaaagccaaaaaccttgtctagactttgagtcacctttatttgtgtactgtaaaagaccggtaggagcagcccaaatggctacagtgaatgggagagcctcataaaatccgacaaaggttcacatacctgaggtttgtaaacacagcatatgttcttgtcagtgtagatgtgaccttgccggtctctttgcagactatattagtgctgtgcaaatatttctactcaattgtaaaggcacattatactcagggaaattattctcccagcaaacagacagatgtttagcttcactttaatatgacactataatctgaattcttaatgtgagacagaggtcctgttggagctagggtgaaactacacatgcaaagttttaacaatgcagcactttgtagcatagattaagtcactacctctttctgactaaaactttctgctctttctttcaagcccctcttgtagcaccatgtgcaggggccatggtgcacttagcacaccttgacaatcctgagatgatgcaggaggtggctgtgaggatatttatcagtctctctgagcactatcaaacacttctgcttgcaaagccctatagaataacatggagcaacatatgtccagttgtgaggttcccctcttaggagaatatgaaacatgcctatcctagagatatcagcaaggctcaaaaaattcaaggaaaaagaaaaagtagctggggatagaccaaacccacatatctagattcattcttgggggctttggcattcaacaaacagatccatcttcaacttgctagttgttgtcaaggttaattatcctttaggacttcaagtaaaggaggccaaggaaactgagctcaactcaagtttagacacagtgaaatttcttttactgctgggactcagcaacaagactgccacccctgtgaggttctctccattttcaatccacttttctacactccgcctgtattgctggggcaggggctcaataagccatatttctgctttgtcagctcattcctgcaggctctgcccataggaaatctagagagacactggaaggctggagctcttcctgtttgcctcctgttccggttggcattattccagcgatgggtcattgccctggcacttggttccactcttcagatttaccctcccatattcctagaacaagactcatcataaccccttggacacaccaacaccaaccagctgcaacgctccccagaggactgggttccagttctgcaagggcctcctccaagctccagagtcctcaacagcaggtggagaaagccctgctatgagtctccagttctgtgctctccgatgctcagcttctaaattcttttcccagtcccttctccttattctgccgtccctgaagtggtagttggttccttttattatgacttttttgtggtgcaccagggtcttttatgtgtgtgcctttccagccctctaatatccaattaaacaattattttatatgaaattatcacagttgagataattgcatggtttctattttcttcactgggccctaattgacataacttattacttgtaacagagttacacagatgtttgctaaattgctgatattatatatttttgaaggtatatttacatgctaaaaatgtatgattaatctgcatctattaaaaagaacatgatagatcactattactgtccagaaagatgtccataatatattgagtgataacagcagtgattttttattagtaagcatttgtttcatatataagaaaaataaataaaattatgaagaagttaaaaataacggatactatgatctctatgagaatactttgttattcctatttaaataactttgagaatatctttagcataagtaattggggcagcaggatttttcttctgcccaatatttagttgggattgcaataactatcaaacaattaagatgcaatttatgtctttgtcacaatttgaaacccaaaacatttatataatatgtgtaattcaaaggcacacatgctactgcatctaaaatttaactttttaactaaatataactaaaaccaactcacagaaaagtctacagctgggaagaagaattagtaaaaactttaattgtggtctcatttacacttctattttcaaactcattcatgaattaattttaactctgtgcctctgccttcaatcaagccataagtacctgtcagaaaatgacagtgtttgaatatctgcacatatgttggaaatttctacactttgattcctttgtcaaaatttccacttagagctgtgtgggtgaggctctaaggcacaggcaaggaggttagtctctcactgtggccaagattccacgccaaagaatgttcatttagcgtgtaagccaacgcagaactccttattaagacagttggccctcagagtcttataaagcaggaggggagtatgatgtatggaagcaaatgttgagcaggaactacagaaggttagccttaagggtgatgttccatagaggaaccttgggctaatcttaatctgtgaagatggacattggactatagagctttgtggcccctgtgcagcctgccattatacaagatcacttaactacaatgtcttaaagcaactcagtctaaggcagtagttgcaaaaattttggatagtatatccctgttggggaaaaaaatttgcgtgcaatgccaccatgtgaatatttattcataaattacatatggatgctgttatactaattattagtacaattaggaacaattagtattgggtaccctccaagacactgaatatcagccagcaccctctcattcagttgtagtcacactgaccttcttactgatcattagccttgctaaacatgccctgtctcaccatccctgcactggatgcctctctgtccactagccacttggttcatattctcacctacttcagggctgctcaaaggtcaatctcagaagggcttctctgacttcctgtgttacctctgaccctctgtctcctctttactctagaacacttgtgctgggttcctctgtttaccttgcagacactgctttccccttctctgtccttttctgtgccctgggaggctgatttgcatggattacattcaactgggctcccctgaattatggcttctctttgggtttggccaataggaggcactcgcagggaactggagggtgagaagagagatgcctggacgtttattccatcagcaaccacccttgcagggctatggatgggaaatggctgttttcctctcccaaggtcacacctcctattgggtgtccttctcctaccaccaatcactgcttcctcttcatttgggccaccgcttcttgccctggaggagatagttccctattattagaaggccctagacgacttcaccattccttgttagtttctcttaaactctgcctagctttctataaatagcttttcgtgcactctcctcagacatttactttgagcatgccatctgtttcttcccaagaccctgaatgatacagcacttatcaccaataaatatagcatatatttatattgatagtctgattcctcccatttgaatggaaaatagccgagcgcagagatttttcacctgttgttgttttctgctatgtgcttagctcctaggatagtgcacagcatttagtaggcacccaggtacctgccaaatacatagatgaataatattttcctcctaggtcccaatggattgtcttgcacattccattttggaaatcaccaacttaaggaacaaatatatattattcttcaccaggttttactaagtgttggactaacctagcttaattcctacataatacatatccctgattattttcaaagcacatgaaatgtaatgtagcaggaaactctcctgaaagttctcaggttcctcctccaagattctcataatgaaagctccaacagatattgagccaatcatgagaaggaccttattagttcaccttttcaagttgtctttaacagattttctttctccctcctgatttccgttttaagaacatttcttcttttctttcaataaggaccataaaaactgcccaaggaagcaaagccttggctcactcactttgtccctacttgcaacaggagaaaaatcatcaaaatcctgttccccggctcagttacttaatttgcatatgatgctccattacttaattatcttataactcttagggcttagttgcccaaatcagacttaacaatcatctttggtaacaacatcccttacagcaaagagctaactcaaaagaaaatgattttttaaaaaaatgacaaacacatacaaatacctttttgtcctccatgcaaaaatttgggtgatggattctttatgaattgctctatgcctattaaacatgcccattactttactattggaaaaaccagattatttttcacatgcctgagtttcctttctttgtactaatcaataactgcagatgtactctaagagttgctaccatactgaacaaaatctgatcttcaagacaacctcgtggaacctgctgaggttgccttgggagggagaacctaagtggtgagaaactgctgaatcctgtatccaggaggaaacattctgtacacacaataacttctatgtgcatgtggctacaatttttaatgctgtgctcatctctggctatatatagtggcatgagtaagagttttctcgtgtggttttgagtttcttgagctgtaaatcaaaacattgtgatgttcaaacagtctttgggaagaagagaaaattaactgccaaaattattaaaatggaactctactttctattagaaccagaatagaacagcttgcatgaataggtaagtgcaaagtaagatataattttctttcacttgaatggcgtttgtatttccctctgccagcagtggtatgactctccaatgttgtattactttgctaaagctgctataacaagtatcacacactgggtggtgaaacaacagaactttactgtctcacagttctggagagagttctcatttaacttgaataattatatttgcaacaaccctttttccaagtgaggttatattctgaggtaccgggggttaggactgcaacttgtacatttgggaaaggggatgtaactgcacactggctcatgctcagctatttgagaggctgaggtgggaagatcacttgagcccaggagttcaagcgttcaaggctgcaataagccagtatcatgccactgcattccagcctgggtgacagagagggaccctgtctcaaaaaaaaaaaattaaaactaaaagaagatcaataaatttgggggagcacaatttaaccacaacaaatggtaaaaataaaaaatgttaggtcttaagaaaatactaagaaacacttggtccagctcttttgttttttagtgataaatagaaagggaaaatgtcttatccagggttacctgtcagcaatagcaacatagactcagagcacgaggcacaaggctctgctctggtgctttccaaagcacacactgcctttatttcattcttcccaaagctgagactcacatgcatttgtggaggggaagtagcagcagtgactcatcctatatgaaaacccatccagagacttatgtgacatatctacagcaacttgctttgtggaggtcattcaaaataggagaattaaaaaaggactaggctggtcttgaactcctggcctcaagagatactcctgcctcagtctcctaaagtattagaattataggtgtgagtcactgcatgcagcctagattcaaagtcttatacaaactttcctcgtttaaatcactgtgtggtttgtctcctgattggactcagactgatgcagtctgttctagtaccagtttgtttttacattgaaatatttgctccatcaggagtttatcttggtataagctgtgagtatggatctagctttatttttcacagatggctatctggttgatccaaacatttattgaaaaacttttttcctaactcattttaaataccatctttattatatactcaattcccacatgtatttgggtttattccagactttaaattgtattccattacactctgtcttttccatctccactaccacattgtttgaatatctgtttaatatctgataggaatagtccctggatatttttgttttttttttttaatttgaactttgttatcagaatgtctagatttcctgctggaaattttattgggaattgcaatacgtttgtagattagggatatttgacatctgagtcttctcaagaactagccactttttattagttcaagtctcttttggtgtttctcaacagtattaaacattttttaattcacaaaaggagcactgtgtatatttatagtgtacaatatatttgatataaatataccaatagcattttaattcatataaatcttgcatattattacttttattcctaaatatttgatcattttggttattgtgatggcatcttttcttccattataactttttaacttgttgctcttagatatataaagggtacaaatatcaaacataaaaagggaaagcaaggtttcaaaactgaattacaaaacttcagtgccagacactgtacctggcaattgctcagtgctccaagaaagttaaaccaacaaataaaaccaattttaatagtgataagtattactctgttgtgattagagcttccaccataaagtattttcaagtccattatcatttgttttctgcaaactctgagagacaaacattattctcatttgacagaaaggaaaactgaggttcaaagataaatgactttttaaactaaagtgttacaatttgacagaaaggaaaactgaggttcaaagataagtgactttttaaactaaagtgttacaagccagtttgacaaagcttgtatgctattataatttcagattcaaattccaatgctccctctcctaaatttttattgttttgaggaaaattaaactaaacattaaaaaagttcatttacttccatttttatgcctcccttgaaatgcaaatttagcacaagccaaccatctctctctaagcatttccaagcacttgaggcatccacttctttgcactcagcagatggtcataaaatatgaacaaatgaagacagttcatctttagactctagggagtcacggagtcacataagcttaggatttgaatgggcttagaggatttctaaataatgctctctggtttataaataaaaaagctaaggcactacgtcctagagctagtaaaaaaaaccagatatcctcactcccaaaccagtgttctgatgcttgtaaaatctggcactggtttaatcagagagtgaccagctggaataaagtcctgatcagattgcttttattctgctttctctgaagccaagaaaggtcatcaaagatgcacaggagagactgcaaatgagtacaatactgtgcaacagtgatattcagaattattaaattggaagccctggtgccctttgcaggcacaaagcagctcctctgtaaggaaatgaaaagaggttgcgtgtcgagggatgaggcttctttctatagagaccccattacagctccagaggaaagaacatcagttccttccagggagtctgtgtaacagataatgtatgcttcttttcaggctgtcaagattcacaaaagagataggaagtttgaggctctattactggtgaccttcccacagaatacactgcatctcatttttaaaaatagcccggctcttgggtggagtatttgatggccttcataaaggaactgaaaactttgggagaagtactgaaaggaatagagtgaaaaagagaaagaagaaagcaagaggcaaaaaagaagagaaaaactggtttcctactgctccttcatctttctgcatctcgaagtggtcacctttttttatctcagagcctcattacctctgagaggtttcctgatggcctcaactcatctctaccatccttcagaatgctaaacaggttggactttgtcaccacccatagaaaccttggttatttccacattgtaaagtccgcattccttagcatagcaagccaggtgctttttggaaattcagcttccactccagcttcattttctgctccacttctccaggtaactcatgctttggccaccgtggcaacttgccactcctcaaacatgccactggctgcccactctcttgggcatgcttttacttttttcccctttctttcatcaatcaatattctccctaagaatcaagactcagatcagaggctcctgtttctgagaaaccttccagccaaaatgaatcactcccccacctaagctttttctctggtctcaaagccttctactctaagctctggttcttttgattagacctaaagacaaagccatttgtaaaccaataacagatctgataactttttggttctcacttataagtgggagttgaacaatgagaacacatggacagagggaggggaacctcacacaccggggcctatcagggggtagggggaaaggggagggagagcattaggacaaatacctaatgcatgcggggcttaaaacctagatgacggattgacggatgcagcaaaccaccatggcacgtgtatacctatgtaacaaacctgcacattctgcacatgtgtcccagaacttaaaataacaaaaaatctggactaattttagatttccaaaaatgttgcagagatagtatagacagttccccacctaataatttttagaagaaatattttatagaaaagcataaagaatgatattaaaaacacatgtatactcattttccatctttatcaaatctcaacattctgccatttgattcagatttttttttaaagatataaaacaatacttggttctccatgtaagtctccttgattctaaggagacttgattctaattcttcctactcagaattaagcactctcctgatttggcatttatggttaattggcctgcttttatatattcactacacatgtatgtatcccagaagttatatttgattgccttgtatgttgttgtacacatatgacctcattctatatatagatcagctgtacatattttgattttcactcaacaatacatttgtgatttttgcagatgtagttcacttattgaatgttctatatagtattttattgtgtggatacacaaaaataattgtcttcaacagatagaaattttagcttctcatttgttttttaatgtagagtaagagaaacatacaacagtgcacattgcagcactgcttgtattagcaaaaacaggaagtggatctggattgatccattaactatgaatcttacccatccttaaacatcatttaagcccttagggtagaaaagaaattatggggaaatcaaaatgatacatttggcagtggtgagaggcttcctgttccttttggttcagcaaaaaactttttattctttagacctacaaaaaagcagaggctttttttttgacccacacccaaagcagagggaaatcagtcagcatttttaagggaactacacatgctacaggggccctttagcgtctgccaagctcttcccagtctcaagaatggaggtaggagatgctgttcatgctattatacagaatggcagaattaagtccaaatggcacctggagtcttacctctttatatcctagttttctgtattcagtactggcccagattgcttttattttctgttgaaataataaactcttttacaaaaaatatgattgtttttcctcagttttaaaatatgcctataaatattctacaggaatagagggtaatagatgagctcaagtattttgcgagttaattaaagtagaacttggatttatttcgtaacgattttatacaaattgaaaggaaagtaagaaacgttattccaaggtgttcaaggcaggccttgtaccatctcacttcccactggttctactgaaacatttacatttatcactttttttccttctgtttattatgagagtatctaatttcataggcatggtggtagaacattggggtgaataagatgatgtctgctcttaagaagttacttgctactccctgaatatatgaaaactttttttttttttgtaaagagagagtgatggtatggttcactaaggaaggcaggagattgagtagttctggagagtcacataggaagcatgttccacatagagggtggatgcaagtgaaggccaagttgtaaccatctatcactgcctccaaggagcacctgcaatagcacatctacttggagtccaagtcctggttttcatagtttggccaattccatcactgcccaaaccatgaagtaagaaaaataatacaacttagttcaagagaataaaaacaaaatggagtgtgccacacaccagctatattcaactattttctgctctcctagagtgccatgcatttgcaagcctccaagcctttgcagatactcctgctttgaatgacattccctgtattctgtacttatccactgtgtaatgcaaccttaaagctaattttaagcattgtctttctaggaaacctttctcactccccccgagaggggtgaatcatccctcccttgtgtatattcccagagaaggctgtttctgcctctgtaaaatacagcactcagcacagtctgacaaatagtctcgtaaattgtgcatgcctctgtgtcctttactcttagaaggcagggactcatctaattcatctttgtcgtgccttcaatctgtggcacagtgctaacatatagtaagtgttcaatgtgaagttcattaaatgacgtatgtagctgcaaagaaaaaaacacgtagcattaggaattagagtagtcaacagatagtggtagtagaattgcctcaaattccatgtaagtatgattctactgaaaataactgagttttttttttttttttgataattggcattaattcccttggctctaccaagagatcttaggttcaattccctgggcaagcaagcaaattgtgtatgtttgagtgggtaagtgaggctattccacatgaatctcatttagaaattatgttcaaagcaggccatttgctactggattcattacctttcctagatagcacagggtgaaatgtttgcttttattaaagtaaataaatagctcataattgtgcctaggaagggaaacttaaaggcaagaagaaaaacactagacagggaatataaaagtgtattattttttcctcaatattgcggttcattatatttttgaaacagttgtgaatggcttttccttaagtaatatctgggctcttttctctagataatttacaggaaaagagaaatataccttagcaaggcaggctaaggaaaattattttaaaactcaaacatatcaggctaaaatattcatgatgtaaaaacaaagcaaacaaaacaaacagataagcaaaaacaaaacgagaagaaaacatgagaataccaatagaagaaaaatatgtaatttggtttggttccagctctggctgtgattaagcatataccatcctccattttccattgattacaaataaataaatataaggagtctatctgaaaattcagaaaagtaaataatgacaggtgaattggggaatgaaatgaaatggaaagtagtatcaatatggtattaagcttaaaggtattttcagttttcttcttaatcctccagcttggactctaggacagcccaaatcccagaactgcacatcaagcagagacaggaaatgcttcaagggaaacatatgtacctgtctgtattctagaaaagccccagtcacaaagccttagactagtgaaagcagcagctatgcatacacctcaaactctggaagacattctttttttttttttttttgagcagagaaactggaaaactaggttcctattgttctctctctcgctctctctctctgtgtgtgtgtgtgtgtgtgtgtgtgtgtgtgtgtgtgtgtgtgaatcgtcattaattttctctttccagtctctctctggttgttttgccctcaagggaagcaagtcatcatgggaagtgtgaaatagcatagggaacctaaagccctgccatttatgacagaagaccagagaaataagcccctggggactagagagtgaagagaaatcatggaggagaaagtggtagagaaaaagtacacctaattttgtgtatgaagtctcaggctcaccactaattggcgcatgcattgaaattaaccaaggcagcgtaacaactgctttgataattaaactatgatatagaacaaagctcaggttgacccctgggtggttggtatgtgtgtgtggagcagacaaactagctctacaaaggaattgaaaactaaactaacacagaagccagagtctaaatagagcaggttgaggttagacttatgacaagaaccatgggagactgattacctgctaagatgaaaaaaaaaaaaaaaaggaaagaaaagaaaagaaaaatcttctctagaggattttaacaggaccagagtctaatatataatactcaaatgaccataaggcaatcccaaattactaaaaataaaaaagagcatctcaaaagtcaatcaactgacatcaatccccaaggtgacccatgatgttgaaattattggacaaagattttaaaggagttattgtaactatcctctatgaaaagaaaaaaattcttttaaaatggatggaaagaaatgttgtaaaaaatagaaaatataaacacgaagtaaatattttaaaaataaaaaataactaaaaaataaactggatgaatgcaatagcagaatggagatgccagaaaaaaaagaagagtcattgaatttgaaaagtagatcaacagaaataatcctttataaataagagagaaaacacaaataaaaaaatatgagcagagcctcagggacctgtgggacatgtcttacatttgtgttactagaatcccagagggggcaggtaagagattggtgcagaaaaaaatagctaaaaacttctcaaatctgtggaaagccataaatttacagatttgggaggctgagaaacaccccccaccaccaaaaaaaaaatttcatgcaaattctcatacttaaaacactaaaatccaaagataaagaaaaaatattgaaaacaacaagtaaaacaaacactttacatatagaaaaaaataattcaaatgacaacgtattttagtgaaaatcatagaagccagaaagcagtattataatctatttgaagtattgacagtgaaccattaattctaaattctatattaaccaaaaacattcttcagaaaaaagtgaaataaagaccatctgatcatagcaaaattaaactagaaatcaaaaacagatatttaaaaacctctaaatattggaaaattaaataactcactttcaaataatcaaaatatgagagaggaagtcaaaagaaacattagaacatattctgaactaagtgaaaatgaaaataccacaagtgatggtcagttctgtattttcaacttggctaagaggtagtccttgttatttaatcaaacatgagtctaggtattcctgtgaggtattttgtagacatgattactgtataattattttgctttaagcaagaagattctgagttgaaaggcgttaagagcagaactgaggcttccctgaagcagaagaagacattctaactatagattgcagcttcagctccaacttatgcccaagagttccagtttctaatggcttgccctatgaatgttgaacttgtctagccagaacccacgattgcattagccaatttcctgcccctactctctctctgtatgtacacacaaacacacacacacacacacacacacacacacacacacacagagtttcttttgtggaaactgactgatacacctcatattaaaatttctgtaatgcatttaaagctttagagaaaaaagttgtacattaaatactgaaaagttacagcactaaatactgaattataagtgaaaaattcaaatcaataacctaggtttccatattaaaatattagaaaacaaaaaccaaattaagccaaaaccaagcaaagaaaaagagaaatgtcaaaggcaaaagaaaaaaaataaatgaaatttaaaatagaaaacaacagatagagtcaatgaaatcaaaaggtggtttgttgaaaaggtcaataaaatttgataaacttctaagaagactgaccaaagagagaagtagcaaattactattagacatgaaagaagacataatactacagacctcacaggcattaaaatgatattaagagaaaattatagacaactctattcccccacatttgacaactcagattaaatgaatcattttattgaaagataaaaactaccaaaactgacaagaaatgggaggtagtggtcacctggatcagcagtctgaggcactcaacccttactgtgcgtagattctggtgcagcgatgccctctctgctccgtgcccaagcagatctccgggcattcaaagcaccggctcacccggattgacagcctgagctgcctcacctttcctgcacagaaatcatggtgcatccaggccctctccacttcatgcccaagcagatctccaggcagtcaaagcaccaagtcacctcgatcagcagactgagccacccaactcctcctgtgcagagactgtggtgaagcagggccctctctgcccaatgcccaggcatatctccaggcagtcagagcacaacatatttgcatggattataagcctgaactgccccaccctttctgtgcagaaattgtggtgcagtggggccctctacactctatgatgaggcagataaccaggcatctggagcacacactttcctgaatcaggagtttaggctgaccttgccacttgtgcagagaacttcaggcaaaaaaggtttcccagccccttgcccagtcacacctttgggggcttggtggcccttcactcatttcttccttggtgctgatgcatgtggctgacactgggggacctgtacatgggcctgcccggtctgacctcacccatctgggtccccaaacccctcaggactgaggagacagctcagacaactgtgggctccatggatgagcccattgctagaggtagaagctagagcttctactggtaaacaagaataaaatatatacccaggcatgttggccacaaccagctcttacccataagtaccatctactggcttgtaagtcaaaccacagaactcaatataaatttaccaagaggaagtgcatatggctatagaagcaaaacaaaaaaccatattcaacattctctatggtcacaccccacagggagtggggggaaagagaaagggaaagaaaaaacccgctaatgatattatagggaaataaagaaaaaagggaaaaatcctacacacagttaaataattataaaaattagaagtcctattatctctggatgagaaaaaaatggtgcaaaaattctggcaccatgaaaaatctgaatgtagtgatgccaccaaaggatcacagtagttctccagcaatggtctccaaccagaatggaaattcagaaatgacaaagaatccaaagcatgtattgagaggaagctcaatgatatctaaaacaaggttaaaagtcaacacaaataaactcctaaataaatcaatgaaatgaagaaagagacaaacatcttaaaaagaaatcaatcagagcttctagaattgaaaaactcaaggaattgcaaaatataattgaaagctttaacaatagactggactagaaagaagaaataatttcaaagcttgaagactagtcttttgaactaacccagtcagacaaaaattaagaaaaaaaatttagaaaaatgaacaaagtctttgagaaatatgagattgtgtaaagtgaacaaaccaacaaattattggcattcctgagagagaaggagaaaacataagcaaccttggaaacatatttgaggggctaattcaagaaaacgtccctaatcttgctagagaggtagacatctagatacaagaaatccagagaacacttgcagtatcccatgcaaaatgaacatcaccaaagcagttacccaccagactgtccaagatcaacactaagaaaaaaatctcagaggtagctagagaaaaagatcagatcatgtacaaaaggaaccacctaaggctaacagtggacttctcagcacaaacctgacaagtcaggagaggctggggtctatttttagcacttttaaagaaaagaaattccaaccaagaattcacaacttgtgaaattaagctttctaagtgaaggagaaataaaatattttaaagacaaacaagtgctgaaggaatttgttactattagaaccggcttacaagagacccttaagggaattataaacatggagacaaattaatgacacctgctaccataaaaatacacctaagtgcatatctcacaggccctataaagcaaccaaacaatagaaactataaagcaaccagcaaacaacttcacaataggataaaaatcttgcatatcaatattaaccttcaatgtaaatagtctaaacaccccacttaaaaggcatagagttgctagttggataaaaaacaagactcatccatctgtggtcttcaagagacccatctcaaacataaacacactcataggttaaagtaaagggctggagaaggttctataacacaaatagaaaacaaaaaagagcagtggtcagtattcttaaattgcgtaaaacagactttaaaccaccaacattaaaaaaaggaaaaagaggggcatcaaataatgaaaaaaggttcaattcaacaagaagcctttactatcctaaatatatatgcatccaacattggagcacacagatacataaaacaacttctagaactgtagaaaaaacttacacagccacacaataatcatcagggacttcagtaccccaatgacagcattagatggatcatcaacgcagaaaactaaaagaaattctgaacttagacattttgaccagttggacctaatggacatctatataacactccacacagaaaccacagaatatacattcttctcaactgcacatggaacatacaacaagattgaccacattcttggccataaagcaagtctcaataatttaaaaaaaaattgaaattacaccaaccatactctcagaccacaatggaataaaaatagaaatccacaccaagaaaatcccctgcccccaacagcacaattacatggaaatataacaacttgcttctgaatgtcttttgggtaaaaaacaaatttaatgccaaagtcaaaaaaaaaatctttgaaataaaagactccatataccaaagtctctgtgatgcagcaaaaacagtgctaaaaggaaagtttaaagcactaaatccctacctcaaaaacttagatctcaaattagtgatctatcattgtacctagagaaacctgaaaaacaagaacaaactgaccccaaagctagcaatagaagagaaataactaaaacaagaccagaactgaaagaaattgagacccccccaaatccatacaaagggtcaacaaaaggttcattgtttgaaaggataaacaatttcaatagaccactacttagattaaaaaataaacagaagaggtccagataagcacaatcagaaacaacaaaagtgacattataaccaataccatggaaatgaaaaagatcctcagagagtataatgaacacctctttgcctgcaaactagaaaacctagaggaaatggataaattcctggaaatgaacaacctcccatgactgaatcaggaagaaattgaaaccctgaacaaatcaataatgagttctgaaattgaatcagtcacataaaaaagccccaaaccagagagattcacagctaaattctacccgacaaagaaaagctagtatcaattttactgaaactatttcaagaaatcaaggaggaaggactcttccctgactcattctatgaaaccagcatcagcctaatactaaaacctggtaaagacaattaaaaaaaacctgcaggccatagacacaaaaatccttaacaaaatactagcaaatcgaatccagcagcacatcaaaaagttaattcaccatgatcaagtaggcttcatttctgagatgcaaggttggttcaacatacacaaatcaatacatgtaattcaccacataaacataattaaacccaaaaatcatacaattatctcaatagatgcataaaaagccttttataaaattcagcatctcttcataataaaagccctcaagagactaagcatcaaaggaacatactccaaaataattagagccatctatcacaaacccacagccaacataataccaaacaggcaaaagctgaaagcatttgaaaatgtttcttagaactgggataaaacaaggatgcccattctcaccactcctatttaacatagtactaaaagtcctagccagaacaatcaggcaagagaaaaaaataaaaagcatccaaataggaagaaaggaagtaaaactctttgtccacactgctgataatgattctatacctataaaaccctaaagactctgtcaaaaggctcctggaactgacaaacaacttcagtaaagtttcatgttataaagtcaacatacaaaaatcagtaccatttctatagaccagtaacattcaagctgagagccaaatcaagaatgtaatctaatttgcaatagccatacaaaaaacacctaaaaatatatctaaccaaggaggtgagagatctctacaacaagaacttcaaaacactgctcaatgaaatcacagatgacacagacggaagaacattccatactcacaaattggaaggatcaatatttttaaaatggccatgctgcccagtgcaatctacagattcaattttattcctattatactaccaatgttatttttcacagaaccagaaaaaacaattctaaaatttatatgaaactcaaaaagagcccaagtagccaaagcaattctatgcaaaaagcagcagccagaggtatcacattacctgacttcaagctatactacaagcctacagtaaccaaaacagcatggtactggtacaaaaacagacatattgatcaatagaatagaatagagacccagatataagccacacacctatgaacatctaattttcaataaagtcaagaaaaataagcaatgggaaaggactccctattcaataaatagtcctgggatagctggttagctgtatgcagaagaatgaagctggacccctacctttcaccatatatgaaccttaattcagaatgaattaaagatttaaaagtaagacctccacctataagaatcccagaaggaaacctaggaaataccattctggacagaaataaattctgccttgggacagaatttatgaataagtccttaaaagcaactgcaacaaaaacaaaaattggcaagcaggacctaattaaataaaagagcttctgtacagcgaaagaaactatcaacagaccacacctacagaatgggagaaaatattcagaaactacacatctgacgaaggtctaatatctagaatctctaagaaacttaaacaactcaacaagccaaaaccaaccccattaaaaagcaggcaaaagacatgaacagccacttctcaaaagaagacaacaaacatatgaaaaaattctcagcgtcactaatcatcagagaaattcaaatcaaaaccacagagataccatctgatgtgtcagaatggctactattaaaaagccaaaaaacaatagatactggtgaagctacagagaaaagagaacatttatacactgttgatagaaatgtaaatttgtttagccactgtgaaagcagtttggaaacttcttgaagaatcttagaactacaattcagtcaacaattccattactggagatatatatatatatatatgaatataaataattctaccaaaaagacacatgcacttgtatgttcattgtagcactattcacaacagcaaagacgtgaaatcaacctaagtgtccctcaatggtggactggataaagaaaatgtggtacatctatactatggaatactatgcagctataaaaatgactgatatcatgtcctctgcagtaacatagatgcacctggaggccattatcctgagcaaattaattcagaaacagcaatctaaatactgcatagtctcacttataagtggggcctaaacattgggtatttattgacataaagatgggaacaatagaaatgggggactactacaggggaaagtgagagaaggggacaaagagttgaaaaactgtcaggtcctaccttggtgacagaatcatttacattctgaacatcagcatcacgaagtatacccatgtaatgaaactgtacatgtatccctgaatctaaaataaaagttgaaattataaaaaaaaagaaaataaggagatagaatacgaaaaatggcctcccaatattttccagcttaatgcctggaactgtgggtatgatgagatatcattcctgtgtgttaccctatattgaaaagggagattattgaggtataagtaatctaatcacatgatccatttaaaagcctagtgttgtctccagttgagaacagagaggaaagtcagagacatcccaagtgtggtgaggatacggagcaagagaaactctaacattgctggagggaacataagatagtacagcaactctagtaaacagtttgataatttgttataaagttaaacatacatctttataacccacctaggccacagcacagcagtaccctacagaaatgaacactatgttaaatcaaaacctgtatgcagatatttatagcagcattcttcattatcaccccaaactagaaataccctaaatgtccttcaactggtgagtggataaagaaacagtggttttgttgctgagaagtattccatgttatagatgaaatactactcagtaataaaaaggaatcaattgctgatacatgtaacaccatgaatgaatctcaaatacattgcactgagcaaaaacaaaacaaaaacaaaacagattcaaaggttgactattgtatatttccatttatacgactttctaaagaaacagacactatagagacagacaggtagtggccaaaggttaggaaatggggattaatattgaccacagaggggtaatactaggggatcttgaggggtgagtgaactgttctgtatcctgattctggtagtggttatgtgactcagaactatacaccacaaaagagtgaattttattgtacataaataaaaaataaaaacagtgaactgctttgattagcttctacattgtaatctaagattttaaactcaaatttgtatttatgtggcaatgaagggcatgatgatactcaccaagtagttttaggaaaaaatgatttactcagtttaaatatttaccttgaaaacaaacctataaggtgaacacaatctcatttttaaccgcattaaatattagttttcttttgtttttaacttgaactacattgaatatcttttttctaagctgccttcgtctaatagacattgctcaggtcttaaagaatcatcaaagcatggatttttttctctccaccgagctttgataagaaagaaaacaaaagcccacatatatttggataaagtgcagcaatctgttccaaatatcatgtaaaatgtcttcaaaacctaaataagcatgctttttgagcttcatctcctgcctagttctccactcaacactcccaccacgatgaactaattaacaacagtaatatggttattacaaattatttaccatcttctctgtgacagacactttgctagatgctttacatatgccaccacattccaggtaaaataatggttcctattttacagacgagaaaacacactcatctaggttaaacacttgcccaagttcacgtatctggtaagtggacagagctgtaatttcactgtgcgtctgagtccagatggctatgccctttctattactactacaccacactgatagttttcttattttcccttaatagtttttcaaatgtgatgccttttttcaccttatttctagcaaaccgactgacagtcttagaggagaacagtgtcccctctagaacgtcttccctaatctgctatgttgaatagaagaatagattggaaccgtaagaaacagcccagttcttatttcaactcagctacatattcatatttccacacagatggatatttattgagtaccccctgtgtgcgagggattgtgttaagcaatggagattagatcaaaaattttataaaagaaataaaccataagaaacttttgtggggatcttatgagtaggaaataagcagaaaagtccactccaggcagaggcaaacagtactaacaaagaaacggaaaaaaaataaaataaaaattatgctctgagaaactaccctttctgccccttaaatgctctttgcttctcttcacagctgtctgacagtgggaattggatgctctaactgcagtgaaatgaccaaggcgtatggagttactgagtgagctgtttgtagagtaatataagctcaaagaatagctagctcaaggagtggaaaggggaaagatggaacgcacacctcaggccaatgtagatttttactccaaatagaattttcatagcctctttaattaaaaagatactatgcaaggctgggcaaaacttgtccaattctgagctacccaagctaagtctttacttcatttaaatcctattaaagcacaatcttctcaaatatccttttatgacatctagaaagtcttattcttcaatttaattttatgagagtgtggattaaaaatatatatgaaaaacaaaaggaattatccaaaaaggcatttccttcaggaaagaaaaaaaaagtcctccacaaagtaaaaggaatattttagttttattatttttttgttcctcttacacatgaggaataaaaagagaatggaaagtctaaaaatcggaattaaaagctactactgcagcgtattttaaattttattctatatagctttcagagaggaaaagcgattctgttattaccctgcataatttttttatagcagagcatagatgtgttgctaatccaatgctaaaatgactatttggcttattcagaattatttgaaccattaactcgcatgagataagcatgatatgcattaatccttttgtgatctaattcatcagtctttccaagttactaaagctattcttcacagattctttattcttctatcctgaaaatattgtgttttgtttattctgcttatcacaaatcacagagaagtttcatttgctttcttactatttccttttaaaaataaagtcacatttatattgtcaggtaaaatacctacacagaggaaccaagaagaatcggcaataataagtggttttgagactggaaagagaagcagtagagaaagtggacaagcagtgatgaaaatttacttgactacacaatggatttgcatgggaaatattgccctgaccattccatatttgggtaggtactatttggtaattggtgttcattcattagtgggtatgatctaaatatggatttcaaaatacactatgaaagaaattccagatcagacttttgacttgaatggaatatttccataagctaaagatctacagctgttcattaatttcagaccaacatttttggaaagtctcaaaccactccatatttccatgaggagtgcctagaaatgaacctagaataaaacatgctcatttttacaggcacctccgagcttacagtttcttatctgtaaagggcaacattatgcttactatcttcataggattaagagcagaaaaatcatatggaacttctacccagaaatttctttcataagaagcacaaaatacttagtgagattttgtttaagtctgtccttgggcatgataaatcaaaactacatctgtgtatgagacatggatcctgtattataaaggaaatcttcagaaagtctaggcttttcttgttgaaggataaagcttagttaacattatttggggatgatctagctagagagcaaccactatagaaaattattacttgcttaatcaggacttgtgctatttcagataacattaatgtaggagtgaaagttaatcttatttactgattttttattagtaggcaaaccagaattttaacaagatattggaaatgtttaaaaatattaatgcatttttgagctttccatttctaccattttaaaaagaacttgtgttttatagtgtcctgtgttaataaaaagctattcttacttatacataaaataaagatgctagagatctattttattagcctaagctagtataacgtatatttaaaataattttaaatatttttcttagaaattataaaagttaaaattgaaaatttaattgatttcttcccaatttataataattattcctgtattctaccaaccaacatttatttagtttctattgatttatcagagtagtcatttgatcacactagagtgggattaaaaaataagcacaatttttttaatttcaaatatcttgcagcctcggaggaagaaaaagatatgggcatatgtaattatataacaaaatagaaccagaaattttagaaaatgtgatatgtgagttatataagggaagcatgccatttggggaatcaaaaaaagaacaagattacagaagaaatgtgagattactcagttctttcttttttctggtcatggaaaggttcagactgaacactgaaaattttttggagaccagctgaaaaaccatgccatggtcataatttgtcattttactttttatcctcactaatattcatgagtcctcaatctttatttttagattccatatctaaagttaatactcaagattatcgatggtattctaaactaagttttgtacaatgcacttttctgaacatctaagttatctgaaaacaacagttgtgaccttcattactgttatagatacagagattaataagaactgatatagaggtgggtaaaaccattgatatagagattcgtaagactcctggtcttagaggaggtccatccattaaaggaagtggattcaagaacatataaatctaatatactgtaatagcacaatgtactgggtgatcaaaaagaggcccttgtttgaaaatatcacacatttctgaaaaccatgtcttaaaacaaaaagtgaaatatctagcatagtgtgctaatcttttcacctctgaagacaatagaaaagattaaattagtaagtaaaggagagaagtaataaagaaaaaaaaaacagaaatctaaaaccaaaaacttagtaagcagtactaaaagaatgtgtcaaaacatgaaggccagcttatcaagagaccatccaaatgctacctatataaaaatgaggaaaaatgcaagcatggctattgggaatcacaaggacagaatttcactcatatcacttcaggctgatgtggtcaaattgattaggaaatgctggaaaatgggtctgcagagtactagccaattgatgaggcagcattctacagggtctcaatctaatttagtattaaatactaattagcatcaccaatttcagttcctgatataacagagtaatgaataccagatcaaacttcctgccataaacaactatatgactagaagttaatattttcagacatggataagagagaacacaaggctgtgatctgtgaaagaaaaacacaccaagtgagatccatactgatcctgaattgttgccagagggcacatttcgagtcttgacatatggagtggagcccatgcaaggaggagcattctcagctggatgaaggaaacacattggactacagagattgtgaggggcaggaatctttcagcagggaagaggacaggaggacgctctgcagataaggagctccagaaatctgcctacgagtctcctagactgtagtgagtattacagtgtacataagcaaggctagactttgtgaggtctagcagagaataacttctggggaattgtgagctgaatagagtttctgaagcctgcataatatggggaaatactgtagttctgacattcagagtggagagactttcctaatgcctcaagcattcagctgaaatttcataaaaattgcaaataaagaatagggatacacgagccttaaagtagtctttagacccattctaacaaagccaaatccaagtctccacagcataaatctgattctccagaaaattaactatcctctgttagaaagagacaatgctttttaaagaaagacaataatatttcagctctaaatatgaagtgaccacaatgtacatcagaaaataaaataactactagaatgtgaagcaggaaaatatgacacataattgggaagtataatgtcaacagatgtggataagactgatgctgtaattagcagataaagattataaaagtagctatcataaatatgttcaatttttctcttcaaaaagataaagtaagcatatacttatttccttgatgagattatataatctcattaaagaaaaactacaaaaaagaatagaaattctacaactgaaaactacaagataaatttttaaagaaattataggctgggcgcggtggctcacgcctgtaatcccagcactttgggaggtagaggcaggcagatcacgaggtcaggagatcgagaccatcctggccaacatggtgaaactccgtctctactaaaaatacaaaaattaactgggcatggtggtgggagcctgtaatcccagctacttgggaggctgagggaggagaatcgcttgaacccgggaggtggaggttgcagtgagccgagatcacgtcactgcactccagcctggcaacagagtgagactccatctcatttaaaaaaaaaaaacaaaaacaaaaggaattgtatagccttatcagtagatggacaatgccaaagtaatattagtaaactcgcagacaagaataaaaggagtcatacaaactaaaacaaaacaaaaaactgtaacaaaaaaaaagaaagaaaagagcttcaatgatctgtgagacaatgtcaaatagtccaaatagtctaatgtataattgaaatgctagaaggagaagagagagaaaaatttggcaaaaatattatttgaagaattaatgatccagctgctgaaaacttattttactattttaccgaaaataaaattttaaaagctgtcagaaaaggtacattacatacaagagaaaaatgataagagttgttgctgacttatcagaaacaaggcaagtaagaagaaaaggggacatgatagggctgaaaaaaactcttgttcagcccagacttctatacccaacaaaatatctttcaaatataaaggtaaaataaagacatttcagtaaaaaactaaaatgaggagaattttaaaggcaagaaatgtcataatatttttatgttaaaggacgatggaacacatatctagttgaaagaatgaattgcacaagaaatggtaaaatgtataggtaaataaaacttgtgtttcttggagagttaatattttgaagagagactgcagtaagttaaacatgcacattataatctctagattaataaatagtaacctaaaaaggcatggcaaaaatgtcaataaaggagaggaaatagaatactaaagattattcagttcaccaaaaaggaggtagaaaaggagaagttgaagtaacagagcaaacagaacaaatagaaagcaaaaatgaaataacaaagagaaaatatagaaaagtagaaaataaaatcatagtgtgcttaatctaaattgtaaataattacattaagtgtcaacagactaaatggcccacttaaaaggcaaagactgtcagattatatttaaaaagcaagagtctggctgggcgaagtgactcacgcctgtaatcccagcactttgggagaccaaggcaggcaaatcacctgaggccaggagttcaagaccagcctggctaacatggtgaaaccccgtctctactaaaaatacaataacgtagacaggcatggtggcgaatgcctgtaattccagctactcgagaggctgaggcaggagaatcgtctgaacccggaggcagaggttgtgatgaggcgagatcgcctcactgcactccagcctgggcgacattgtgagactgtctcaaaaacaaatgaatgaataaataaataaatacaaaaattagctgggtgtggtggggtatgcccatagtcccagctactgaggaggctaaggcactaaaatcgctagatcgttagaaccgaggaggcggaggttgcagtgagctgaggtcgcgccgctgcactccagcctgggtgacagagttagactctgtctcggaaaaaaaaaaaaaaaaaaaaagcaagagtcaactatatgctgtttataaggaatattctttaaacacaaagacacaggtcaaaaggaaagggatggagaaaacatcatgaagatgttaatcatgtagaagccaatatagttatatagataccttacaaattagacttcaccaagtaatgcattatcatagataatgatgcatattttataatgttgaaagtgacaactcatcaagaagacataaatcttaaatgtgcattcatttcacagaaaatctctcaaactctcaaagtttctaaactaaagggagaattagatttgttcacaatcgtagttaaaaacagtaacaccagtctttcagtaattgttggaagaaatgaacaaaagtctgtaagatatagcagttttgaataacattataaatcatcttgacctaattaaaacattacacataagaactgcaggatacatattcttttcaagatagatcatctactagtttatttcagactatcaataatcacatagattgcattctctggccaaactgtcatacattaaaagttaatcattattttaagaaaatacgcacatatttagaaattaaacaacacagttctaaaatacttatgtgtcagacaaggaagcccaatggaaatttttaaaaattactgaacataaggaaaatacaaacactatgtattaaaatttgtagaatgcagttaaagcagttcgtctgggggaaatttatagtgttacatgtctacattagaaaggaaaataaaagctataaaagcaatggtctaagatttcatcttaagaagataaaataaaaaacaaattaaattgaaagtaaatgaaagggaatgttaaaaatgagagtgaaaaaaagacaaaaaaaaggaaatcaacaagatcaaaatttgaagaaaagattagtaaaattgattaataaaactcatcacgatgaaaaggtaaaacaagaatcagcagtatcagaagcaaaagaagggacctttctacagacattataaagatgataaagaaatattatataattttatgctaattagttttacaatatagattaaacgggcagattccatgaaacaaaacttagcaaaactaatagaacaggaaatggaaagtgtgaccaaccctgtatacattttagaaacttaattttaattaaataattcttaggcacaaatggcttcactggtgaatactatcaaatatttaagagctgtacaatatccatttagcatattctttttcagagaatagagatggaaatcttcgcattttattttatgaaaatagcatatctttgataccaaatccagacaaaggggaaaaaaacccctcaaaatcctgaccaatacctctcatgaacccagacacaaaaattcttaacaaaatattagtaaacaaaacccaataacacatttttttaaaaaaaggttctatataatgactaaatgaatttagtacaggaattcaagcttggctaaatatacaaaattaaattaatgggatttactccattaaaatattaaagaaaaaaagcatataatcatttagattggctcaaaaaatctatttttaaaaactaaacagtcaatcatggaaaaattcttagcaaactagaaatggggggaagtcttcaaactaatacaatgtatctgctaaaaacttatagctaatgacataaatgattataaaatattcaacacttttcttctgagatctagaaaaagacacagatgtatattgacagcatttcatttaatattttactagaggtcctagatagttcagtaaagtaataaaaataaatggcatagagattgtaaagaggtaaagccattgttgtttatagacactgtgattgtgaacacatacagttctaagaaatccgcagaagaaaaattcctgtgaaactaaagtgaattcactaatactgcagaatacaatccaatctagaaaaaaattcggattctatataccggcaataaacatttgaaaaataaaaacaaaaatgtcattcaaaatattcaaatcataaaacttttagggttaaatttaatgggtggtgtgcaagaatgctctgctgacacaattaaaatattgctgagagaaattcaagaaagtccaaataaatggaatgatataccatgcttagggtttggaaggctcagtattaataaaaagtcttttatctttaaatagatctaaaaattcaatgtaattcttatcaaagtctcagaagccttgtatttttaacagaaacaaatggattctaaagtttatataataattcaaataatctaaaatggccagaacaatctaaagaacaaagttggataacttaaaaacttaccgtaaagcttcagtaatcaaaatagtgaggtattcacattaatataagcaaatagatcaatggaacagaattaagagcccagaaatagatccatgcttacatactcatatctgtgtgtgtgtctgtatgtgtgtgtgtgtgtgtgtgtgtgtgtgtgtctgtgtgtatgcaaaggtaccaaagcaatacaatggggaaaataagctctttccaacaaatggtgctgctgcaactagatattcatataggaaaaaataagcaaactttaacctctacttcatatcatatcattttcaatgaaccaggataactaaaactataaaaagtatacaaaaaatgtacaaaaagatctttttggtcttaaggtaggcaataatatctgaggcagaacacaataggcattaaccattaattgaaaaatgaataaattatatttcatcaaaatgaaaaatcttctcctcattaaaaggcctttgcaatgtaaagctatttgttgctccatggttgcctgaatgccagcacccacccccacttgttttgaacttttacctagtcattgcccatctctgggtactcatccctaacatgtatattttcaagcaataagtctcatgatgacttcaccgttttaccccttctttcctttccatagtaactcagttacattcaaattacccataagaaggcttcctgcatgccacagctacttcacccatgaccctcagtaaagccacttgcctagaggtccttattctgtttcctccctgcctgccacaaacgtttggcttttgggtgactttgcatggccctctgagcatgtggtgtctccttctctaggacctatgagtataataaatcctttaatttcttatgcctctccagatataatttccgtgaccatactggagtgaaccttaaagaccccacaaggggtatttcctcccccacttatgacacagccttaatgagaaataagcctgtaacagatagaaaaaagtatttgcaaaacatatatctgacaaagaacttgtacccagaacaaatatcttagtaatacaaaataaacatcttaatattttttaaacttttattttatatttaggggtacatgtgaatatttattatataggtaaatttgtgtcattggggtttgttgtacagattatttcatcacccaggtattaaacctagtacccaatagctatcttttctgctcctctcccttctcttccccaatcaaatagaccccagtgcctgttgttttcttctttgtgttcatgacttctcatcatttagctcccatttataagttagaacacatggtatttggttttctattcctgcatttcataagaatgaaaacagaaatctcacgaacgtctcaataaatcatctatgtctagaataccccttctctgtctcctgagttcaataatatattctacttaaataactgagaatggacggcaggccttatttgtttacatggattccatgaaatgcaggagctacattttctgttactgctattgtttgttagggattagtacccagagatgagtacccagcgccatccgcgatcctgcaaaagacacggtcctgttttttaagactgcatagtatcccatggtatatttgtacctcattttctttatccaatctgtcattgatgggcatttagattgattccaagtctttgcttctttgctattgtgaatagtgctgcaatgaaagttcacatgcatgtgtctttatgttagaatgatctatattcttctgggtatatacccagtaatgggattgctgggttgaattctagttctgcttttagctctttgaggaatcctcatactgctttccacaatggttgaactaatttacacccccaccaacagtgtataagtgtttccttttctccacaccctcgccagcatctgttattttttgactttttaataaaagccattctgactggtgtgagatggtatttcattgtggttttcatttgcatttctccagtgatcagtaatgttgatcttttattcacatgattgttggctgtatgtgtgtcttcttttgaaaagtgtcccttcatgtcctttgcccactttttaatggggttgcttttcttttatacatttaagttccttatatatattgggtattaaacctttgtcagacacacagtttgcaaatattttcctccattctgtaggttgtctatttactgagagtttcttttgctgtgcagaagctcttaagtttaattagatcccatttgtcaattttgcttttgttgcaattgattttggtgtctttgtcacaaaatctctgcctgttcctatgtctaggatggtattgcctaggttgtcttccagggtttttatagttttagattttcaattgaagtctttaatctatcttgagttggtttttgtatatggtataaggaaggggtccagcttcaatcttctgcacatggctagccagttttcccagtgccatttattgaatagggagtcctttccccattgcttgtttttgtcagctttgttgaagatcagatagttgtaggtgtgcagcatcatttctcgactttctcttccgttccattgaccagttacttcacaaacagttatttacaactagacaacatgcacgtgaaaaactattcagcatcattagccatcagggaaaatgcacattaaaaacacaattgattatcactacacacccaatggaatagataaaattgaaaacactggtgacaccaaatgctggtgaggtgaaacaactccaatacccatacattgctgttgcaagtataaaatggtactgccattttggaagttctgatagtttcttaaaaggttacagatatacctaccataagattcagccttttcactgttaaatatttacccaataaatattaaaatctatgttgacataaagacttgcacacaaatattcatagtatctttattgatcataaccccaaactgaaacaccccaaatggtcatcaaaaatcaaaaggaaaatagataaactgtgatagaatcgtacagtgaaatgctgtctggaagtaaaaagcaaagatcgattgacacatgcaacatgcgtgaatctcaaaaacatgatgttgagcaaaaatgtcaaacagaaaaagaatacatattaaaggactatattatatgaaattctaggataggtagaactgacctatggtgaaaggaatcagagcattgattctctctgagagagtggttgattgagaaaggatccaaggaaattccctggggtaatgaaagtgttatatcttggtggaggtgtattacatagacatttacacttgtcaaaattcactgaattttacagctatggcatatgcatttcactgtaaataaataatattttcatttctacaagactacccatgtgattagtaataaaacctgatacttgcttctgcctttcctaggagagccatttaatttcttttctcccccattactgggatgtacaacaaatgataatcaaaatagcagattttgacagtactgaaattggtcagaacactgggaagatactgcataagacaaaagaactcacttaaatgataagaagaaatgggctgaattcagaaaaccagctgaatttatttaatatatttttccctaacattttctacagtaagcccaacatgatgtaatatatgagggtattaagaagttaaggcacacttggaaaattgccattcagacttatagattaaacaaatatcagatgtggaactacattcttaatcatgaaattttaacttatactgtcagactatacaaattatttggaacatttcctccctcttcaaacatttagaactataggggccaggtaaacatcaaggagaaattatgcataaataatacaggcactgtgctttcacagagtgtttttcctggtatttaacatttgccagtgtgtctactgtgtgcaaccttccccctcaggatttagctgtggtggcaataaaggcagtgaagttaggaagactctcatcactactatcaacagccacattgtgttcagcttcttggttgacttaaattgtgcaatcagggtctatccacacattcagctatattctgtcacttatgatggagccttttgtgtctatgagttaaaggtgtccagggagggaaatgtaatgccctgactcattccaacctttaaaaacaaagcattaagtcaagaatatagtaaagaacatcccagtttcacatgttcaaactttggttgaactaatttgtaactgcaaagaccattccaaactgtgtctagtggtcaagactcctttatgtctctttctctatttggaatgttttctctctctttttccctgatggttaaagccctactctgccctactcttcactcaagactggcaaataccacaaccttttcccaataaattacatcatcaactttaggtattttaaatatatttgctcatgtctcttttttacaggactaggagctcattgagggcaggtattttgtaatattaatctttgtccctggggtctggttcacagtacatgtcaaataactgtttgatgagggaccaatgacccgtagaaagcagaaattttgaaataccatcactcctaaaattagattaggtgccaactttataaagataatttcagcttaagatattcagttatgttttagattattttttctcgagttttcctctacagtaatattgctttttatctcaagcctaatctactttcacatctttgagtctgctttcaattttttataggaaatttttttttatatttcattttaaactcttttgtgttttatatttggtcacccttaatagagtgtgccatttatccaccatgaaactaactctgtccagattactcaccattttatgttccctgtcagctttcttcacatcagcaaacctgaacacttttcaagctatattcctatctagggcattcataacagagagtggtttctgtcatcatgaataacttttctttctttcctaaaaacaaattggggattattgtacacaatctctctcacataaggctttctgatttgtctgatttattccagtatgatatgcaatatcaaaagtacattggaaatcttaataaattatctgtacctagagtacctcttctgtctcttgaatgcaataatatactctacttaaataactctgagaatggatggcaggtcttatttgtttttgtgaatcccagtttacaaaaaaataaaaaaggtgtttttttttccagatgactgcatatgtatttcaccttttatttgtttactttttattgatttaaagtcatatacaaaagcaaaacaaaataagacaccatgtctggctgtatatcaagcataaaaaacactataattaggtaaagtttcagcaaacaatcagcaacaagatggtttagttcctggacaacaataatgaaactcaatgactttgttagtccctcacactgtcatgattggagataaaatttttaaaatcctatgccaacaaatcaaggacagtagtgtcactgcttgggtggcaggggaagcttgccatataaaaaggtgaaagaccttttcaactattttggtaagagcacctcaccttgatttctgttctttttggcaaatatttccaacacgaagtctctatgcaagagttgactttgaatagtataactatcattactattgtatttgattatcttccccaaattattcttattctagtgtttttcaagttttaatgaattctgattctattagactactaatgtaatgaaagcactctaccctttcaccaagaaatgtgcatctataattctctatacaatctcacagaatagtatgatgggaaaagagatacaaaacaaacacaaataagaagaaaccatgcaaatacatggaaattaaataacctgctccttttgggtcaaaaacgaaagcaagatggaaatgaaaacattctttgaactgaacaaaaataatgacacaacctaccaaaacctctggaatacagcaaaggcggtactaagaggaaagttcatagccctaaatgcctacattgaaaaggctgaaagagctcaaactgacattctaaggtcacatctcaaaaaactagagaaacaagaacaaaccaaacccaaacccaacagaaaaaaggaataaccaagatcacagcagaactaaataacatagaaacaaacagacaaaaaatacaaaagataaatgaaacaaaaagctggttctttgaaaaaataaataaaattgacagactattagcaagattaagcaagaaaagaagagagaaaatccaaataacctcactaagaaacaaaacagtacatattacaactgacaccactgaaatacaaaagatcattcaaggctactatgaacacctttatgcacataaactagaaaacctagatgagatgaataagttcctggaaaaatacaacctttcctgcttaaatcaggaagaattagataccctgaacagactaataacaagcagagagattgaaatggtaatttaaaaattaccaacaaaaagtccaagaccacacggattcacagcaaaattctaagaattctaagacattcaaaggagagttggtaccaatccttctgacactattctacaagacagagaaagaaggaaatctccataattcattctatgaagccagcatcaccctaatacccaaaccaggaaaggacataaccaaaaaagaaaactacggactgatatccttgatgaacacatatgttaaaatccttaacaaaatactagctaactgaatccaacaacatatcaaaaaaataatccaccatgatcaagtgggtttcataccagggatggagggatggtttaaaatatgcaagccaataaatgtgatacaccacatatgtataattaaaaacaaagactacatgatcatcttaatagatgcagaaaaagcatttgacaaaatccagcactccattatgattaaaactctcaacaaaattggcatgcaagggacataatgtaataaaagtcatccatgacaaacccacagctaacataatacagaatggcaaaacgttgaaaggatttcctctgagaactggaacaagacaaggatgcccactctcaccactcctcttcaacatagcactgggagtcctagccagagcaatcagacaagagaaaaaataaagggcatccaaactggtaaagaggaagtcaaactgtcactgtttgctgatgatatgattatatacctagaaaaccctaaagactcctccaaaaagctcttagaactgacaaattcagcaaatttccagatacaaaattaatatacacaaatcagtagctgtcctatacaccaataacaaccaagctgagaatcaaatcaagaactcaaccccttttacaatagctataaaaaaacaaaaatacttaggaatatacctaacaaaggaggtgaaagacctctacaaggaaaactacaaaacactgctgaaagaaatcacagatgacctaaacaaatgaaaacatatcccatactcacgggtgggtagaatattgtgaaaatgaccatactgccaaaagcaatccacaaattcaatgcaattaccatcaaagtaccaccatcattctttacagaactagaaaaaacaattcccaaattcatagggaagcaaagaagagcccacatagccaaagcaacactaagcaaaaaagaacaaatatggaggcaggtaccacattacctgatttcagactatactataaggcaacagtcaacaaaacaacatggtactgatataaaaataggcacatagaccaatggaacagaatagagaacccagaaataaacccaaatacttaaagccaaatgatctttggcaaagcaaacaaaaacaaagtaaagaaagaacaccctattcaacaaatggtgctgagatatttggcaagccacatgtaagagaatgaaactggatcctcatctctcaccttatacaaaaatcaactcaagatggattaaggacttaaatctaagacctgaaactgtaaaaattccagaagataacatcagagaaatccttgtagatgttggcttaggcagggatttcttgaccaagaacccaaaagcaaaggcaagaaaagaaaaaaacaatgataaatagctgagacttaattaaactaaaaagcttttgaatggcaaagggaagagttagcagagcagacaacctacagagtgggagaaaattttcacagtctatacatttgacaaaagaacaatatccagaatctaccacgaacttcaacaaattagcaagaaaaaaacaaataatcccatcacaaagtcggctatggacatgagtagacaattctcaaaagaagatacacaaatggccgacaaacatgaaaaaatacttaacatgactaatgatcagggaaatgcaaatcaaaaccacaatgcaataccaccttactcctgcaagaatggccataatcaaaaaatgaaaaaaaagtagatatcggcatggatgtgctgaacagggaacacttctacactgctggtgggaatgtaaactactacaaccactatggaaaactgtggagattccttaaagaactaaaaatagaactaccatttgctctagcaatttcactactggatatctacccagaggaaaaaaagtcattatatgaaaaagatacttgcacatgcatgtttatagcagcacaattagcaactggagaaatgtggaaccaacccaaatgcccatcaatcaatgagtggataaagaaactgtgatacaaatatgtatatgatggaatactacttatgatggaatactacttagccataaaaaggaatgaattaatggtattcatagcaacctggatgagattggagactattattctaagtgaagtaactcaggaatggaaaaccaaacatcatatattctcactcatcagtgggagctaagctatgaggatgcaaaggcataagaatgactcagtggactttgaggacttggggaaagggtgggaagggggcgagggataaaagactacaaatagggtgcagtgtacactgctcgggtaatgggtgcaccaaaatctcacaaatcaccactaaagaacttactcatgtaagcaaacaccacctgttccccaataacttgtggaaataaaaaaatttaaaaaaatgtagaaaagattttaaaaaaggatgaggaaatatttacttaataatccattcaacaaatatttattcagaatattctatgtgccagataaaagcagaaaataaaaaaaagacagaaaaactgcagatctgactaccaaatctgatattttgttctatggaaaaaagtaacagcaataaataacaactcaaaatagataaactattcaccaaggcgattaagagaggggtacagtaaaaatacatgaaaattaaaattcaagggaaaaacaaaatttgagggaatttgtcatcagcagacttgccatgcaaaaaatgtgaaaataagttcatcagaagaaggtaaataatataggtcagaaactcaggtctatataagaaaggaagaatgttatagaaagaataaatggtaaaataaaatcttctctgcttcttattcttcaatactctaatagataagtttgttcaaaataataatgtatcttgtgactataatttatgggtgggtgaaatgaataatagtaatgtcataagggaaatgagggaagaattgggaatattttaagaaacttgcactacctgtgaagttgtatagttgtatttgaaattgaacttggattagttgtaaatgtattttgcaaaccccagggcaaccactaagttaaaaaagaaaaagaagaagtctggttaagagacagaaatcgagttgggttttagacacaaactttgagaaacttattaaatatgcaagtatagttggtggggaagatgaagagaaataaggtaagaaaatgaaatgaagcagtcagtaagataggagaaaaaccaagagaggatggtttccagaatgcccatgaagaaagatcctcataaaaggaggttaaaaagtacatttaaaagtatattattagatgttgagtacctataaaacagaatttaaacagtggttgttttggtgtggtggtttttgtgggtgatttaattttttttccattctgtttctaccttttaaaactgtcatgcagtaaatatgcaacactgttgtaataagaaataaaataaaaatcatttttaaagtattgggtcctttactcctacctaagaataaacattctttatttttacctttctactagtgtcaggttctaagtacaatacttagagatacacatattatagggaaatctgttggtaaaaatgtcctagggcacactgttcaatagagatacaataggagatgcatatataattttaaattttctagtatgcacattgaaaaaaatgtgaaattaatattttattaacttagtatatccaatgtattatagtttcaaaaatataaccaatataaaaatattaatgagctatttcacctttttttggatgtctttgaaatcctgtgtgtacttcacacttatagcacatctcaattcatatttaagtgcttgacagttacatgtggctagtatctaccatattggacagtgtgttctagatccttgttcttcaaaatatggttcacagatcagctgcattggcttcacccagaaaaaaataaatgcagaatcttaatccttatcctggagctactatatcagaatctctgtttcttttttttttttttttaacttttaagttcagcggtacaagtacaggtggtttgttacctaggtaaatttgtgtcatggcggtttgttctacagattatttcatcacccaggtattaagcctagtatccattagttatttttcctgattcctttcccttctcccatgctccaccctctgaaaggccccagtgtgtgttgttcccctgtaagtgtccatgtgttctcaccttttagcttccacttataagtgagaacatgtggtatttggttttctgttcttgtgttagtttgccaaagataatggcctcaaaggaatataaattattctactataaaggcacatgcatgagtatgttcattgcagcactattcatgatagccaagacatgaaatcaacctaaatgtccatcagtgagagactggataaagaaaatgtggtacctataaccatagaatactatgcagctgtaaaaaagaatgagatcatgtcctttacagggacatggatggagttggaggccattatccttagcaaactaacacaggaacagaatctgtttctaacaagcactcaaatgatactgttgcagctcgcttcacagaccacactttgagtagcaagactaattatatccagcccaatcattttctagaagctcttcagcagttccttaacctgttttctgctgtaatcctctcttcatgtccatcattcctccaaaaagcaattattatgtgctggttactgcgtgctaatgctttacaagttctatcatccacattttacagaagagaaaacagaagcactaatagattatgtaacttgctcaatatcacccagctagtaattagtggagttgggatttgaaaccaactagcctgcttccagaatccagtgtcttaaccaaccattatttgtttatatatctgtctcttctacttaagatacatctagctcttcaaagatatatagcttatacatcttttttctacaactatttaatacagtaaatgtttttgtaaagaagggagggagggatggcttcatttgtgttttcctgctaggactgcccttccaggtccaattgccccagaatttccagtactcaagatccctgttttataggtgctagtagacatattattgtgtggaagccatggtcagaacacctgccaggtgctatcactgtgtctatcatttcacattaatattaagaaaacatttatgaaattctataatatccaaacagaatttttgctaaaatgttttcctaattaaaaaaaaattagtataaatgataacctaacaggtctgagttttacaagtagaagttttgctaatcagtgaaatgcccataaaggaagtaggagaggagacagtacaaaactgagataattctaagtccaaacaaccactttcttgatatctaggtggtaaattttattgtacatcaattagtgatcctcttttcagattctcttttcattctaatcaatctaattccatttacatttgctcagttaacatgactgctttttggaaagggtccaattcttcttcctttggaaatttcaactctctatttctcatttgactgcaataaagtggctgggatgttcttgagagttatgggtagggaagttctttgtacccttaggtggatgcacgctttggctgtcaacacctagttgcttttcgtaggaggtgctgccaggtcagaaaaaccacttgtatcatagatggccccagtctttgcctcaaataaaacagataccagaaacagggagaagaatctgcccttttctgagaggtacaaagacgaccatggtgtgcatataccctcaccacttaagggctgtgtgccctcgggcaagttactcaggctctctgaacgttatgtttttaactgtgtcaacgtgaactagataaacactatgaatctcaggttccatctgtaatttggcattttgacttatcacctagggtttctgacagcaatgagaaaaatgatggaaaatgtagtgcagagtccagcacctgacaaataataatccattagcattttccttcaatatatttcctactgaactacaggaattttgaggcctcaacttgatattatccctattttaaactttctaatggccagctgcaaacacatccatgtcaactccctccaaaatgttatttgtcctttagatctatttcagatgtatttcttgctgaataatctttgtatgcaatgacccctgtatttacttacaactacatcatcaacatcctaggacagggtctaggttagtttcatttcccttcttgggcatttactacaatgccaggaataaacaggtgcttaataaatgccttttgttaagccaaacgtggtggctcacacctgtaatcccagcactttgggaggcagaggtgggcggatcaccagaggtcgggagtttgagacaagcctgcccaacatgaagaaaccctgtctctactaaaaacacaaaattagctgggcgtggtggcacatgcctgtaatcccagttacttgggaggctgaggcaggagaatcacttgaacctgggaggaggaggttggagtgagccgagatcacgccactgcactccagactgggcaacaagagcgaaactccatttcaaaataaataaataaatgccttttgttgatgctaggcattcctaaagtctttggaaaactttccataaccacccctcctctgcccactccagctctgccctctcacctatctctgcggccctccatcacagaccttattcacttaactgcaaattgggcactgttcctttgtttttattacaaaacatttctaacataccaagaagtaaaacatccgtgatttactctaccactcaatttttcatgaatgttgacattcgttatattattttggttctggtttttaaagatctataaatgtttctgatatagctgtgaaccttccaatcctattctcttcctccctccttggaggcaaccactgtcctgttgtgtccataagtttcatttttgctttactataaaaaaaaggagttacaatacccctcttaaagggttatgaggcttaagcaaaatttatactgtgactgacaaagagttaaaacaatagtagtctctgtcatcctcatcatcaccatcattgttatcctcactcttgaccttattatttttctctgcatattcatatgtctcctccagtaggtctttgcttttctgagatctggaactatttattttctctatatgcctatagcttagcccagttcctgatatataggaagtacacaaaacttgtaaagtaaatacatgctgtaaaggctggactgattaccttccattctctgatttcaggcataatcttaaagcacattaggcatagttcttcaccagttctctaaaatagtaacttgaccagaatatgcaggctaatatccattcaccctcaaaaatccagagtaatgacaatctctttattctttcaaggggccctgatcacctgattgttagtatcacatattcatctccaatacctgacaccagaaaaacaaaaacaaccaggacaaaactaaggttcccaaagtccagaggctgaactaaaagataatggatagatgagcactcagtcttctggcatcctcaataccctctcagccttttagattgttataacccaacttgctgtttccttttcaattatcaagatttacagaataaaaaaaggtgaacttgtctttaaaaattattcgcgataaaattcgattttgtttacttgatgctaaatactgataggcaaggaagtggcaggcaatcttactcggtttcccccatacactaattaaacattttatgcagatatcagcataattaaagaattaggaaacaataagaagtgcttgggataatttgtaatatcagtgcactgatgcattgggtccagataccaggatttgattggcaggactttattaagttttggcagcacttaggtagtctgggagcttttttatgaggctcgtgcacattaatccaagctcctgttgtcgttaatactgatgagtgaaggcagttaattgaattatgtatgaagcactgctgattaaataatatttcactccccactacagaattcgctctgctggattaacatctactgttgtctctgacactgaatgttatacggacctcttctgaagcatacactttgattctttcccatctgttcaactgatgcagcatctcagttgccactggaaccaactatccttcagctctgacatgaggtcactttggagaactgatatagttatttattagcatccgtgtaaccatgaacagaaatcctccccagtgcctcaggtgttctaagggcattattatttaaattcacggtggaatgtgaagaaaaattctaattatttatcattgtattctgcttaaggtgataggaagagaaaataactcaaggtcttccaaatcagccttaaaaataagtattattttgagctgcatatgtgattttgcctaaatttatacacctcctcttctcatgtaatctggagttgaggaaacagaagtctctcccagtggaagatgcactcaagtttctttttctctctcttctacctccctccttcctttgttcttttattgataaattacttttattgataaattactctcttcttttattgataaattactaagtgccagatgctgtgatgggtgctggcatgcagagataaggaaccagtagttactcttttagagtagttcacatcttaaaggcaataaaataggtacatatttaatatcatgtggcatataatatatggcacgtaacagagatacacatgggcagaagggagaatgactaactctacttggagaaatgggaaaaactttgaaactggaggcaacaaatggtgaatcttaaagagtgaatagatattgtccaggttccgactccatcagaaagaaaaagggcacagagtgtattcaattgcatgtagccccatggtccattgaggtacaagagtagggattagattgatacataatccaagagtttttttccccctatgacttggattatttgttgaattgtttccttagacttccaaggataatgatgtattaagaccctacatggtataatgaaaggaacatagatctggcaagagaccaaatttgcacgtgaccttagtcaagtcacgtttcttttctaggctttaattttttcaactctaatataaggagttttgggcaggacacatccgactgaaggtttgcagaagtcctgagagacagtatgaaatgagattggtctgtctttaggagaggtaggctggaaggctaccttggtgaatttactatagttcagtatctggtttctaattttggaagtccagaaacttctcatcaatgctacagagatctggacttgagtatctgatctacacagactaaatttagaataaactatatacatatagaccaatttattgatttatagtaaatactcttgtcagcttgccctaaaatttattaaaaattatagggaaatctacattttaatcaaaagttactcaagtatggacttccagcaaaaagaattgaatgatttaaatattttatgatattagaccctaaaaacacctacctcattatatccatatccatggtagagttttgtctgtcaaggagaatggctttaataagatgggccagaaacccttttctaaaaacagtgttaaagaatcacctctcagactttattttcttctagacttttactactcaccaattttccttttctataggtctttttttctttcctatagtttactacaaaagatgcgtgaatggaactgaatgtgatggcaacccagagatcaacaaataggcgtagccatataagaagaaagagaataaaactgataaaatatcaagattatggttgatacacaaagttatcacagaggagtaaaaccatgtaatatgatttattgctcacatctcaagttataaaatatttggtacaaacaaaacaaccaagagaaataaaataaaacccaacacccagcatttggattattagaaaaatgtcattctttaattaaaattgttaattgcttttatgttgtgcttcacgtactacaaataagttaaaaaaatagggaataagatgcttgaaacacaaatgctgaattttatttatatggggtagcattttttaaaaaaatatgcaaacaatgatttaactaaataattgaaatttggtcattaggagaagacatcattcaaccattgagaaaattttaaaaacctcatcaggccactttaacattttcctgaaagttatattaaatccttacatttggtgacattccctaaataaggggaattgggtctaacaaaaagaggatgtaaacagagaaaagtatagccaaggttaattccaaaatttctgtaatatctgagaaagttatgtgttctttgtgcaaaggttctctgactatccaggcctaaggatgactcaactgagatggttggattttcagaactgaattcctgtgttattcttgctttcaaacttttccagtggctgacttttagcagtggaacctaactgggccagcttttgtgtctcctcacatattacatttcttcttccccaaggagctgtcatttttctccttcttgaaataaattcatctaaagagaatttctctcaatcaacttcccatcattctctctggagtcttcagaactcactattatactgtcaaaagcctgccatccatgcattcactcaaacacaactattgaaagcttaatgataatagtagttactacttaactgaactcctcagatatgccttgtcacctgtactgtgggttcagtaataaataaagcatttttgtccttgaggagctcccagtaaaccaagagaggcaaatatgtaagtagttattcatgtcagaggaagagcaccaatgaggaagcagctcattcaaatggtgaccctcccacattccctattcatggtgtcatcatccatcctgtcctccacacttcacaatcatacccctctcctctttcacctttttatattaaatggtgttttctccttcagaaatagctcatatctcttctgtaatgaactaggtcctccacatctctagcctagacaattacaatcacctctttgccactagtatcttccttccttaaattattattatttttaagcggtgctggttcaaaaatttccatttggtctgacttattcacaaaaacaagttcaatctcctcgacatggcccatggtttaaatcttcccagtgtggccctcttatatttctccagcctaatttcctatctcatatttcaggatacacaaaactttccttaattccctaaacatgccctcttctttaaattatctgtagctcacagcatgtacttttctctacttggtaagaatttcttcctgactccatcttcttcataaaaatgcttattcagttgatcagaaatcatgcccacttggcctttttgacacccaccttgtaaagggctaacagatggctacacccaaccacagcagggtaccccaaatgagagcaaaaacttaccttgtaaataacagctgaggaccccactccagccaaacacaaaacaatcacaggtgataaaaacgtcaccaagagaacttctgtaatatgcacaacaatttcccccagatctaaagatgttaataaatttctgaaaatatctaactttctcacagccaacagatgtaggctaggggttcagagcttctaggtgacagatattagattgtaccttaagcttcatgactttcaatccctctgtctggttggtacctgctcagcctttaagttttggcttatgttcaatgtcctcaagagatctttctagatgttcaatccagattgatccccgctatcatctttctcatagaatctggttcttttccttcatagtacttacgctaatttaccattgtagatctattatttgttggctatatttttctgcacttgttcataagctttgtaatgagtcattcatccatccatacctagcgctgttttgttcatccatgcatacctagcactatcctggcacagagtaagtctcaataagtatgtgtagaataaatataattccattttgcatcatgccaggtgacataaaagtgtaaaaaagtagtagatggtatgttcttagtttggtccatggataatcaattattgatgaaaatctacttctatcagggtagctaaatggtttccaagagttttgtctgtatgaggaacctatggataccttgagacaaagaaggaaaaaagtactttgaaatttgcaatcatgctcagcaaagttcttctcacactctccaggggatggaaaactcatctggaggtagaagagagttaagctgtccaagattctttcatgaaacatgttgatttttgtgtgtgtgtatgtgaggtgaaaagaattttagatgtaacacaatgttgagacaaatgttatctgactcaaactgggagaaatcatatttaaaatagcatggtctaaaaaattaaaagaacagggcaatagtttcagggatcatcaaagaaaactgacaccactgagtaaacatcgcaccagagtcccagtgaaagaagcactcagagtaatggaagaaagtcaacataagctgttgtaacaatgtcagcctcctgtgataaccctaaggtcactttcctagtgggaaccaagagacagaaacatatggggatcatggctatcaagtggcaaactggaaagcagcatattaactgtagtatctgccaaggtaaaagataggtcgccctggacccagcccagtgcagacagacagaggaaggattgggatgctaagttgttccattaggtggggacccaggtcaaagcctatgttctttacagaaccatgtcctttgttcacccaccctagactgctacatactggggatcaaggataaaaatgacttctcatgggagtaaatgaaggaacaatgaaagtagtataataattttgtgcttaattacacattcagactgcaggtgctgtagatagctagtgacaagagaatggccatccagaaaagaatgggatacaagtatttgccctcctgcagttcttcatggagtgtagtcagccaagaataaatttaactttactttcttttaatgcctgtccctgggaatttcttatcccataaaacaccaaccttataaaattagagcaccatccctttttcctcgagtggatttctcttctcattttccttttattaattaaaagataatgctctaaactctggcagtaccccttttcactgtgggctcccctggcccactttctgcagtatatcaacttatttatatttatttgtcctaatacctatgttttcaattggtttctattatgcaacacaccacagggaaagagtctagtattaaaatcacactgtgtagtttaattccactttaatgctaggactctggttttaatcaacttattttgatcacagaataattctcagtaataatccaggggtgtcaggcaggccatcagctgagagtaatcaaatgagtctctccacctcttctctctctcttccatatagaatagtgcatttcttccacttcacataaactggagctaaagccaggttccaaattagtctcgtgaaattgtaactgactctctattaccaacttgtaatgggaattaatggagtgaataatctaaaatcatgggtggttctgaattaatgatacttgtcttgagtaacacaatatatgctttttccctccaaaagatgtacatttcttattaatgatgttttcttgatctctaagtagacatcaagaaaaagaagatagtactttttagaatgccaagcaagcgttgtttggggtactttgtaaacactgtcttgtgcaatcactccatgaggaaggtattcttctagtttatggagtaggaagttcagagcagcagaggattgtgggaaaacctctgggctaagagttagggaaaacagttctagatcatcacacaggtattgaaaatgaaggatatgtgttgcggcaatgtagctaagttggaattttgtttttaaaatgttcttttgctgcagttccgagttagtgtgggccacaagagacattttgtgtgggactggaaggcagaagtaaggtgtcagccatgttctttttatgtgggcaagattggtgttgagtatgaggcactggtgtagtgcacaagccttgtcacttttctgccagcctgagttgtgagtgtggggcagtgactgggcctgcagcaccttcagttcctgctggacatcctctgtgtgttcatatctgtgaagaaggatgccagctcttcctgcagatcattccatcatcaaagttgaaagctgggtatggtgagagactgatgtatgtttcagctgtccttataggttccagcctgtccattctgtccttgtttccctgacttcacatctgtcttttcttctctactgctttacatgtgggcttcaggctctagcaccaagacacagaagcagtagcttcatatagactgtttatccagcacccacaattgcgtaacatccaatccttggaataattctttactctttacagctcctatcaggtctgcttctcggatcaaactctgacaatgagcaatcctaggaaatcattcctctcctcacgtaactgtttcttaatcaataattagtccctctggctctatggtgaaaatgaagcatgacacagaattgtgctaagggttttttctttctgttcagataattcacaaaataggcaatttgcattttaataatcataagctaaattaacaggtgatgctgttgtgaaggtaagaatcactattgggaattatatcttggacttcatgatgtgagcaacattttaaggaagtcctcaagccctgggccactgatgtgacgaagcctgtgatgaagatgaaggttgagagcaagacctatggtttctgaatatcctggtttcatgcaggtgtagtgaaagcaataaatccacacatgagtttaacaccttgtttctttcaagtgctttcacagatagtggccacacttgtcaaaatgcttgccttataaacttgctgtgagaaacacattgataatggatctggagacctcaagatgaagctaggcacacagtcatgaattaatggtaattactatgctttacttttgtatgtctctttgactttcgctagctctcttcagtggatcttcagagtaatcttgaaatgctgttaacacccacttaagaggaaataagcacagagtataaaaatggcttgcttgaaggtcatatggctggcaagtggtacaacaaggaccaataatcaaattcactgaaataatgatagagctgataagtatggaacatataagcatgtgtcagatattgcctatgcatatcagttcatttaatcctcacaaataaacctatgagggtaataatagtatcccttttttatagattagggaactgaggttcaaatattaagagaggttaagttatctctatgttgtatcaagttaaacggtaatgaggattaaaatctcgactacagatgatcaagtggctggggggtgggggtgggtatagtgttctaagcctcagcttattaacaatgaaacagtacagtacttatctcaaactgttattctgaggactaaccaagctaagataagtaagctgctgataccatgcctgacatgtactgagcactctttttgttgttaattgtctcactagggcttagtctacgaagacctggtgcctttattgcttaaccagggattagttcactatggtccatgggtcaaatccagcctgaggcctgtttctgtgtggcctatgaggtaagaatgtttttaaattttcaaaggattgtaaaaaacaaagcagaatatgcaacagaggcctgtgtggcttgcaaaccctaaaatcttcactatctggtcttttatagaaaaagtttgccaaaccatagactatccatgctgttttttcaaccttgtgatgcagaactaaaagagacagaaagcctatattgatttagtctaaaaatgcagagctcaacttagagatcttggaagatagaggagtgaatgaaagaagtagaagaaaactgtgtttggtgtttttcagtgaagtgaataagactacatgagatagtagatattctctgccgttgctgttgcacctttctgtaagcaattaaagtataagtaactatagggaagttttttttttaataggggatattgctccctgtcatgccacgtaatctcttaccatttttaggagacattctagtaaagattattataaatttttgaaagtggatttgtgttttctttagggtgctgcactgtatagaaataggccatgaggcagcccaactttattagggttagatatgtatcttctcaaaactatcctgcctgaagcagattttaagtttctaccattcacatctttctatgataaaaatgggtgtttgggagacagcatttatcttcatgaaaaatacacataataatgttacagcgaagtcattgtgctggagagctcagggcagccttccatttggctgaccctgaaggcaacagttaccctgaggttcaaggctactagcctcctttctaggtcaaaaataaggaggggcaagaagcacttaagacagataacctgatagccactctgagatttatcctggttttaacaaaaatatgttaggaagagagtaaagagcccacacatattaaagcaaacaagtgcttccaagactcccatgaaactttaattaatggcacatgtatacatatgtaacaaacctgtacattgtgcacatgtaccctataacttaaagtataatttaaaaaaaagaaaagttataaatgaaaaaaaaaataaaaaacatgaatctcctggaaatgtttcttggttggcccactgcagaggtaaggtgtgtgagaaagacaagcagtgatctgtatcagggagagaggggaggccagagggcatgtgagccaagcctacaaattcatacagggccataaaaagtgcaggtgactctgggactacatacaggaggtgctactgcaaagaagtgaccagcctggggtcatcgaacagagaatgtagaggaggcaagatggataattatggagtcaaagaaaaaaagtccaatgtctaaaccaatggtgagacttcagggggttctttaaatggatgcctgcacaaaaataaataatgagcatgcactatatctacacttatttatggattattttcaatgaataattttattttattcttaaaattcatgtagggagaaggaatcaagttctccatttcagaaattagaaaagtttcaaaaagggaaaggaagtatatccattaagctcctctgatggacattcagggactccgtagacatttccacattccctcatataagcatcgcaagaagccagtttgcttattaccatgtatttaggtgttattgttgtcttttaacatatgaaaaagttgtgactgagaagtttagtcgagatcccacacaattagcaagctctaaagttggaatttgagccctatgtctggctataaccttgacctctttccattatacaatccttccttctctatgtaggattatcctaccttcagaaataaggagacaaaggtttgcacaggaatgaggtttgctgtctccaagtctcttgttctttctagagatcaagctgcttccacttttttcctcaggttatacgatgggcctgtcaacagattgatctccttattgatccctgaatatagtcccattaacctgtggaccactgtacatgttgctccccttgccacagataacctgacctgttatttacatttttcaagtcaaacttgagcatcagctcctcctggaagtcttccctcacccctttttcactgtgacaaccatcatggctccccacggatgccctccagtttataaagatgcctgtcctgtgggttcccataataccttatcatctccctacaagcaaataccacagtacattgtaagagccagattgcatatgtatttcttttattttaccatatattctttgaaggcaggggctgtgctcactgtttccccgggctccagcatggtccctgactactggtggtaagttagtatctgttaaaagaatgagtagatgaaagctttgtttacctttttaataatttttaggctacaattttgaatagtagatcaaagaaatacaaacaggaatgttcattattttattatttatccaatgatactggagtaggagaagcttcagacagagggatttgatatggaacttgcaactcaggtaggaaacaaaagttcacacaaaagggaaatggatacacttagttgcaatgactttaaggaaaaggcagagaaagagacctcccacctgtcctgttgacttttatcagcttttactttgttttgatactgagctaatcaaattagtatctatttccacttctatgtgcaaaaaagcttatttctaagggattaaaacatttcctaaaaatattcagaatagatacttatagtaaaaactaaaacaaaaaaaaaaaaacccttaacacaacacataataagtatctgtctcttatgaggacaaccaccaaaaataacatgcacatcccaaagggctgcttcctcgttacattaatacatcaaaatatctacttatgatgattgatttgtagatgttgatgctgaaaacccatttatcatttgcactgcaatttgcccatctttacagatcataaaaattcattgaattatgcttcttcttatactataatttaatatcttgttttcagcaccagaataaatccccataagtaataatttccctatgttaccctttagcagtcagtcccaatcaatgcattttatatacacacatgcatatgaaaagttaatgaaacaagtttctcacttcataatttcttaactggaacccaaaccaaaagacacagagagaagtacctacctatttaggaatcagaacaacaaaattacccagttaataagaaagtcagctgcatatttctaaaataagtataacatcttgctcattccaccaaaactgtaatttataaccaacactgtggaaaagacacatgtatgtattttcttagaagttcacagtagagatttttagtacagccattctacgccttagacactaacaagacaattaataaaatgatgtaacactggagatctggaataaatgtatgacttttgcattattagtacacatgacattatcttaccttattttcacatcatttctacaaaatgctctaagtattttaataattaatatgtactttttcaatcttttagagaaagtgaggcatggagaagttcagataatgcctcaaaaatatgaatgagatagtgaaaacgcaaaatgaaaataagataacagaccaatcccatcctctaatgcaaaactctctatttttattgtaaaattatgaaaatccccaattatttttagcctctgaagaaatttgctaattgttctcagacatccaaagctaggtcaagaacaagactctttttccccctcaagtcataaacttgtctaaaataaagtaaaacaaagacttaagaaataagaccctcaagtactaaagtgcttttgaacttcaatcgtatattagcaagttattctgaagtatataaccaagatcctggatctccaaaaatctcaagttgtgaatacctctatagcacatcatttctcccataaaatgtaggaaaatacaaaataataattcagtgaaccctttaggaccttaatgattctacaaatacattaataaaatcatttaaaaatctataaaaataaattctgcttcccaaataaacacaacaccccattatgcttccacattactgttgtgacattattgtgaagttactggaatctttaaagaaacttttaatctccattaattattgatctctaaacaatgaataatggatgacttccaaagcttattgagatgaagaaggtgggcagtccacctgggctactccctggccaaagagattggccagatcacactgtgtgtttccagtctatgcctcagtggtattatactcatcacacaatatgactctttagggtactttgtcaataggaaacaccatgagtgttgcatactgcctggaagagctccctttaactggtttggagaacagctgtcaaagccatttcatggattgacaattctttaccagactttcatggtccaggggagctattggggttttgtctgctatgttgatgtaatgataaacttttcaaaaagatccttttacatcctcacaaattctgtttcagagaactttctctaaaatgtattgatctcttggctctattgacttataataattagtcatatgataaacaaccagcggctggagaatggtgggccataaaccagatttgctttcaacatctggtcatggaaggagaagagtgacacttgaagaggtaagaaaggtgagggtgagctgacttaaaggttcaaagcaaaaagatgaaaaaaagactgcctttatgtataaaaatttccatcacacagagagcgtcctttgttcttaggggtgatgccatattgcaacttttatcccatgtaattggtaaggtaatgagatggccaaagagagatgatgctgaaggcacatactataaaatcgctgatgaacagagaccacagattttggtctctgtctctgtacaaggaagtagcacctgatattatttctattgactgctccagtattacactagcagttcctacagaaggaagtatgaactcatgatgggcagattactctattctgtccctttgttcccaactagctatactgaaaaaagaaaatggggtagaaaattataaaatatttaaataaaattggggctaaatatggggctaaaattataaaatatcacaataaaaatttcataaaatttggaatattaaaatgctaatgccatgtgcttctactcagatttagcaaatgttaacacttaccattctttcaacaaatctctctttgtgagaaaaaggcaaatgtagtggaagatcaattttcatcacttttaagcatttttttccctctttccctagaggtaatcaaggtcccaaagctgttttatatcctttctgattgttgtttgtatatttttatcacctatctgcatctccacataacacatagcatttgagttttaaaaagttttacataaatgtaatcatatagtatttatgctgcaatttgctttttcacacaagattggttgagatttttcagtgttgataaggaaaaatctagctcattcaagttcaataatatattcctgtataaatacatcttctaaaaaatgtcattgtgattcttggaccctcttggaattttaattagaatattactaagttgattaatctgagattaatgtcttcattatattaactttagccagtcgtgcacattgtgattctttctctttcatccaatcttttagatccttgaattgcacgttataattttttgattgttgttaaagccattttacacatattatgtacatagttagaggttccttgtagtcattattatcaatggaaatttttttcctattatattctctattttgttatggctgatatgtaaaaacactctcaagtttttatattgatctgatgtgcaataaaccttttaaacacccttctaacagtttggctggaaattcattttcaaatatctatataatcatatcatattcaaatagtgacaattttttttcttcttttccaatcaacctatagtttatattcttctcttttctttccagtaacaaatttaagtgctagcagtagccttgaatatcttatatcttactaaatacctgtctttaatggaaaaatttcttacatttcatccataagtaaggtgtttgctagaatgttggtggatactcttcaatagattaagagtatttgatccttaggtcgataagaatttttattatgaataatgctaaaatttagaaatattttttcctacttctattgaagtgattgtgtgattgttttctttaatcaatgtacagaattatactgagagatttttatgaatttttatgatagtggcctatggtcatattcctggaagaaaaagacttaaaaaatagttcaatgtatttataatactctgttggatttaatttgctgatgttttatttacaattttgtatatatgatcacacatgagaatagcttatacttttttttcctcttctgtttttatctcctcttgatgttaagactatattagcctcataaaatgaattgggtagcattctttatttttctattctctgaaacagtttggactatatatgtaccatcacttactcataaatccatttatacctatagttttctaagaaagacattttataatagctactggttcgttttggtttcaaactaagttttcaagcaactttaataatttaatttattaagaaaactatccatctcttaatattttaaatatttggtgtaataaaatgactgatcaaaatagtaccatagttttatctttccactgtatctacagttgcattattttttcattactcattcagtctctcttttttcttaatcagtcttgctaatttattctttaatacaatcagttttatttttcaaagggccagttttacttgtattgatcatctcttctttgttttctatttcattattgcttctttccagaggattcctttgcaaacaaagttctaaaccatttgaggaaaactattacaaagaaagtcgataaaatcaacaattaagatttgactatactccaaatagaataaagatcatagaggaaactgaaagtaaattttaagtgagatggttcagaatacatgcctagataaaaacataagaactatttttattgagaagataacgtattagacaacaatcactagggaatggggtgcgtaaagtatttaatgtataattgtcttttggagggaacagcataggaaaactaaataatttacatattggttaagtatgttaatttaatggagtactctgctagagcttttctaatttcaattttttgtttttttctattactgctatgtgtttgaatcagaagaagggcaatgtcatcttgacaacttacatattgtaagttatagatcctccagtatctttcttttacttaggaaactttgaaagataacctcagtctcaagtgtcatgtagatcttagatacataaagttctttgaacttgctcaattaaaaaaatggaactgaaacatgaatgtattgggcttcctatccaagcttattttttgatcctgcttttgaatacctttccctctttccaaacagaagagctgatgctgctcttgagggcttggcatttttctgcctttctttgtttaaggtttcacctttccctcagttcctcacctaaatactagaccatgagcttctagaggataggaagtgcttcttatctttttgactttggtgcctagtacattgcctggcacagagtactgaagagttatttctctaatagttacaagtgcttccttttgccatttatcttagtctatctcatctctatagatatgaacatagcccttaaagacactacaagtctaaatctcactccttcaagagtcagcctccctctattgtaaagcttttctttatagtgacaactggaaataattcaattttgaaagtttttttttaacgtgtctcttttatgccacttattgttttctataccataagacagtgatttatggacatagattttcttttttacaggactgtaaaccctctaagaccaggatccatctaatttttgttctatacaaagcaaaacaatttataaatatttgatgaataaatactttataacataaaggaaatgatcatgtttgaatttttcacttgtttgccttttaattaatcattattttcaccaggccagtaagaagattgctgaactatggtgctgatgtgtcacctggagagcagatgtcctatgggcatgaaatgttgccttacttccttttaacaagaatcaacccctcaacgttggctttgtagcaaggctacataaaattaccaggcttttagaatacctctaaagcaaaggtcaattataatttgttggataatttctcttctaaatttataattctgagatgtttaattttagagtgataaaaattatgattcaaaactcacattttaaatcagaatgagcaaattcaacaaaaacaaagataaacagatgggacttaattaaactaaaaagcttctgcacagcaaaagaaataaatcagcagagttaatagacaacccacagagtgggagaaaatcttcacaatctatatatccaacaaaggacgagtatccaaaatctaaaaagaactcaaatcagcaagaaaaaataaagcaatcctatcaaaaagtgggctaaggacatgaatagactattctcaaaatcagatatataaatggccaagaagcatatggaaaaatgctccacatcactaaatatcagggaaatacaaatcaaaaccacaatgcaataccaccccactcctgctagaatggccataataaaaaaattaaaaaataatagatgttggcatggatgctgtgaaaagggaacacttttacaccgttggtgggaatgtaaacttgtacaaccactatggaaaacagtgtggcgattacttaaagaactaaaagtagatctactgtttaatccatcaatcccacttctcggtatctacctagaggaaaagagttattatagaaaaaagatacttgtgcacacatgtttacagcagcacaatttgcaattgcaaaaatatggaactaacccaaatgcccatcaatcaatgagtggataaagaaaatgtgctgtgtgtgtgtatgtgtatgtacatacacatacaccatggaatactactcagccataaaaaggaattaaataatggcattcacagcaacctggatggaagtggagattatcaatctaaggggagtaacctaggaaaggaaaaccaaacatagtatgttctcactcatttgtgagaactaacctatgaggacacaaaggcatagaagatacattggactttggggactgggggaaaatgtgggggatggtgagggataaaagactgcacattgggtacagtttacactacttgggtgatgggtacaccaaaatcccagaaatcaccactaaataacttaaagaatgcctgggattttttatattttgttcaacatgaacttattaatattatttatattagaaaaatgcatgttagtgctgtttcagttagactcagaaaagctgatgtaatccaatcaaaaacttaaatccattctatcagtagatgtatcattaaggtttaaattcaatgagcagggaatgaagtcaagtttcagcaaatttactgtagaaaatgatgataagaagtgtgcaaagtggaatgctacaaacacacaagcagttggcgggggcgggggagggggcacagagacgggatcctgtcctgagtcagctaattaccaacctggggaagttacttagcccttctgagccttactttctatgcctaaaaactgggaattgtattgtggatttgaagaatgtttgttaagaatactgaaatgtatgtacatatgctcctaataccatatttggagcctatcatttatgttataatttatgatcctttatcataatcatttattattatgaggatgatgatgaaaattttccatagtcagcaatcctgggcttcatagccctatgatcagacttgcaaattagaacttgagtttctgctgcgatcaggtaaatgaagtttgtcctgagggtcatgatcatgacagtatgctctggtgcaaataattagggcaatttaaaaaattacattctcaatggtttgggcattaatcttttctaaataatcataataaagtggaatagtccatcttaagaagaagttatagccaaataattttgttcaattatattaaccaatatataaaacatgagatgctttattaaagcaaatgagaaaaaaaatctactttgccaaaagaacatttggatttttttctttactatataccaatgctctgtaacatgggagagctatttcctactttataatgaaaatgtatgtgaaatacacatgcaagacaaggacggcatgtatgataagtgatatgacccaggaagaactacaggagatcatgatacaaacaagggtctatgaactggtggggaagagagagtcataaagaagacagggaccagaaatacatgctaatggagaaatgacttcagcatcatagaagaaataagtaaaaactcagaaatgagaattgtttttcccaggtaactagtctcaagggtatggtggtgaacacagttgtgttttaatgcaatccacagaaaaaatggcagaatagtctgtgaagccaaacagcagtgaaggtgagtgcaaatctgggatgaataagggagggattagccaaggagaccttccacctgggaccccaatatgccatgaactgagctggttatggtagcttgccatttattaggtttaatattaatactaagcaatttactacaatgtctcataatctttacaatgattttgtaatgattatcttgatattacagatgaagaaactgaggggaaaaagatgttaacttttgctgattctttcaaaatctctaattcttacaacaaccttagttcagcattattaaccttattttcaggtaagaaactgaaatttggagacactgagtcacttaacaatggccacacagctgataggtaggagaatcaaagaatgaatatggatctgtgagaaaacacagaatcacatacatgcatctatgaggacttgaggtaacacactgtctcctattatttgaaatggtagaagctgagtctaggtcacatggttatggaatatctattatatgcaaaggtcaaagtttatagaattttagaggtgaaagggcccttagatatcttttattgcaatatgcttactttatacataaggaaatactccaagaaatgtaaatggttcaaagttaaactatgttcagtacgttcagtgattattaatataaagaatggaatcatacacacagaagattctgccccacctacatgggtaattttgtgatgccaaatttaacattttctaattaattgtctacaatttttcaatatcaaataattctctttgtaaaagtagaaaactggagaatgataagtttgaacataaaaaaggaaatggaaatgtgttaattataaaaaaaaaaatgtcctattttaaagttaggtggctgttagcattttttttctgctcaggcttgaccctgagagggcttcctctgctgtagatagggagttaggaaaactattcctatctaaaaatgaaaataccaatgtagcttacttgctggccaaggtgtacatatagacatcaatgtcatgtaacaaattttaacttaaatcctgcaatgagtataagaaaatcctaaattgataaagcaaccattctctgggaaccaggaaaagcaaaaacaaaattgctctatagaaatacttttacaaccatcctcacaaggaacttccacagaaaaagagatatccattgaataacagattcctaaccaaaattagaaacaacaggaggaaataaatcaatgtaggagtagtcagaagctaaaattaaattgataatgtatgctgtaagaatcaaaaataatatatactcttgaaaaagacaacatatttataataaaaatgtaacagaagagatagaaatcacaatcataatgaaagaacaagacctcctatgggaaaaagaaaaatcagatttaaaaagaaaccagaatagactgataaaaatgaaaattataagaataaaattaaaatgcagtgggtgtattaaacaacagctatgattagctaaagagggcattagggaattggaaaacagatgtgaagaagccacatagaattcaacacacagaaacatatagaaaaatttaaaagatgaagagatatggaacatagaaagaaatagattaccatccaagaaacaacttgttagagtatatacttgtggcttgttagtcttcccttatgtcttcgatgatggtatttaattgacttcctgttttgtttttgtgatgtctgagttacttacatattcagaagtagattacagtcatcccacattatccacaggggactggtttcagaaccccactctgataccaaaatctgtagttgctcaagtcctttatataaaataacgtagtatagttgaccctccatagccatagtttccccattcatggagcgcttactgtgctacactgatccaattttgattctgttaattcgtgtaagcatagtacaagtttaactatttattaagtgaatataaatagaactctaggaaactagaggaagcaaagataaatcatgacaaacaaaaatatgatagaaagtggtggaagtatgaccaaatataccagtaatcaggatgaaaattggaattaaacttccatattaaaaataatatcaggtaccatttaaaaataaccttataatgaaaaattataaattcatatgaatttatgaatgaaaaattataaattcttatgaaagaggaaagcaccaagacaagtgtagaaatataaggaatgatgactaatcatgccagctgacatcaggacccatacaagtataagttatagacaactagaccagtggcagaagggaaagcctagaatcacatgcattatgtgcaaagttggaatacgaagaacgtggcattaaaattaatatggacttaagaataggctatttaacaaattttggtaattcaactggctgtgggaaataattggatccctacttcatattaatacaattcaagaatttcatacagataaaataccaaaatgtgaaaagaaaagttataaaatttagagagaagtataatatttttataatcttagcacagaggaggattaaggaaataaggtacaaaatctatcagctatcatggaaaagttagttaagtagataaatgtgacatattaacattttaaatcgtctgtataagcaaagttaaatgcctgagactgggagaagatatttgctgggcacataagtgatataatattagtatccagaactctgtcactttgataaaaaaataggcaaataatataaactaaaaactcacagtagaagatacccaagcaagtaactagatgctcattttcacttgtgattcagagaaatgcgtatttgaaaaacaaagatatctattcacatcagcaaaatcttgcaattaattgggcaaatatgtcaaagaagaaaatggatgaataattgtggtacatttatacaatataatccttaagatcaaataaataaactatacctacatatatgaacatgaatatatttcaaaatataattaaaaaagcagtttgcaaaggacacatatagtatgtgcaataattatgaacacatgtatgtaccaagagtaaaaggtgatgtactaacgtcagtgtagtgatcccttctagtgaccaagaaaacacagaacacaaaaaacaaacaacaaactggaatgaagaagtatatagacgtataatgacactttttctaagaacaaaacctctgagacaatacttgattattttttgttgctgccatttgtctttggaactgacatcatgccggggttgggtcatgaagctgatgacttgatgtaagttgcatggatgttgttagtttcctcttcaattgccttttagctccttaaaagcaaatggaatttgtccccaatagtatattttcaatgactgatacaatttataaaatgtgagttgtcaacaaggagcatgatgaggagaacactgaaaatatgaacaaatcctaagaaagttaatagctagatcttgaatgaacttgagaggaagttatccaaattgaaaactaaggcttaaggaggaaggcaattgccagaggccaagtgactgatgagaagtaaggatttacaagccacaggtctccagctatttcttctaagcctgtggtacataaagttctttgtgtcagagacttccttgagagtctgaaggaagcttaaagtctcaatttcaccatttcttcaagaaatgagcacatatttgcaaaatttgcatataatttctgaagcctaaggtctgaaaccttacctaagaacatccactgttaagaatttctgtggacaagtcctaggctacatgttgttggcataggatctaattgggaatgctgctttttatttaaacaaatcagatattctttcaggtcaaccacgttggatgtggggaggatcatttttagaatgggagctcctcagagatggtagtttccaggtgagtggaagtagacatcagagttccaggtgagtagaggtagacattggagtctacttctgctcaccttggagtagacattggagaagggtgggatggatggaaaaggagaatcctttgggagaggcattggagtttgctgccatagcttgatctaagagctttgacaggctggggctttcagacaccaggattcaaagcagctcagagcatctccatgcaaagcatccagagtgctttgtagccatcctttcccataatacaggcaatctttctgttcttaattgcacaatttgtcctaagaaattagaagaaacaaagaaaagccttacaactacatgagagagattaactttttaaggaaggaccacacccaccatttcattaactctatatttccagtgcattgcagattgctgggaatttcaatcaccactcggtaaatgtattcattgcattgattgcaaaaagctaatttgatttgctttggatgtttctcctcctccaaatctcatgttgaaatgtgacctccaatgttggggtctagtgggaggtgtttgagtcatgggggtggatcctcataaatgtcttggtactgtcctcaaggtaatgagtgagttctcactctgagtgcatgtgagacctgactgtttaaaagaccctggggccagatgtggtggctcaaacttgtaatctcagaactttgagaggctgaggtggatagatcactttaggtcagaggttcaagactagcctggctaacatagtgaaaccctgtctctactaaaaatacaaaaattatccaagtgtggtggcacatgcctgtaatcccagctactcaggaggctgaggtgggagacttgcttgaaaccagtaggtggaggttgcagtgagccgatactgtgccactgccctccagcctaggtgatagaatgaggctccatctcaaaataaataaattaattaaaataaaataacctggcactttcttccttgctctcttgctccctttctcaccatttgaccagcttctcctttgtcttccaacatgattggaagattcttgaggctctcgctagaagcagatgctggtgagatgctttctgtacattccgcagaactgtgagcaaaataaacctcttttctttataaattacccaatttcaaatattcctttatagccatgcaaagcagactaccacagaaaattcatactgtggtatggagcactgctataaagatacctgaaaatgtggaagcagctttgggacttggtaactgacaaatgttggaagagtttgaatgtctcagaggaaggcaggaagaaagatgaaggaaagtttggaaattcctagagacttgttaagtggttgtgaccaaaatgctgatagaaacattggcagtgaaggccaggctaattaagtctcatatgaaaatgaggaagttattgggatctggaataaagtttacccatgttgtgtgctagcaaataacttagctgcactgtgtccatgtcctagggatccgtggaagtttgaacttaagagggatgacttagggtatctggtagaagaaaatttctaagcagtagtattgaagatgtggcatggctgcttctaacagcctacagttaattagacgcacatgcaaaggcataacttaaagtttgaatttacaataaaaaggactgcagggtgtaaaaatctggaaaatttacagcctggccacatagtagagaaggaaagaccattttcaggagaatagaccaagcaggctgtggagcaaccacttgctagagacattcacatgactaaatggtagtcatgcactcgtagccaagacaacgggataaagacctcaaaggcatttcacaagtttctgaggcaggtctcccaccacaggcccagaggcttggaaaggaagaatggtttcatgagccagaactggggcattgctccccacttcctggctgcggctcaaggcatcccaggtacaactccagccagatgcttcagatagcacaagttgtaagccttttcagcttccacatagtgcaaagcctttaggccctcagaacccaagagtgaaggaggcttggcagcttccacccagatttcagaggatgtatgggaaagcctgggtactcagacagaagcctgcttcagaggaagagccctcagaaagagcctttgctagggcagtatagaggggaagtgtggggttggagcccccatacaaagtccccaccagcacactgcctagtggagctgtaggaagggtcatgctgcccttcagaccaaataatggtagagccactgacagcttatgccctcagtctgaaaaagccacaggcaatagactccaacctgtgagagcagccgtgggggctgtaccctgcaaagccatagggacaggccagcccaaagtcttaggaggccatccctcatacccatgttcccaggatgcaagaagcagagccaaaggagattatggtggagatttaagatttaatgtctgctctgctgtgtttcagacttgcatggggcttgttactcctctcttttggccaatttatcccttttgaaatagaaatgtttactcaatgcctgtaccaccattatatctaggaaataaataacttatttttgatttgacaatctcgtaggtagaagaagcttgccttgagtgtcagatgagactttagacttttgagtgatgctggaatgagttaagattttggaggactattgggaaaggatgattgtattttggaatgtgagatgaacatgaaatttggaggaccagggaagaagtaatatggtatggatattttgccatttccaaatctcatgttcaaatgtgacttccagtattacaggtggacctagtgggaggtgtttgggtcacgggggtagatccctcatgaatggcttggtgctgtccccatgataatgagtgagttctcactctatgagttcacatgatatctggttgtttaaaagagaccgacactccttcctctatctcttgcttgctctctcaccatgtgacatgcttgctcccactttccttccaccatgattggaagcttctgggggccatcaccacaaggagattctaatgccatgcttcctgtacacccagcagagctatgagacaaataaacctcttttctttataaattacaaaattccaggtgttcctttatagcagcacaaaacagacacacataattctaggttctttttacaaacaccaagattcagacattttagtggtttaaaattagggtaaagagtctcattgccattattctctttaatgaacaaaacgttagttgtgaaattatatattttaatgaaatatagtgtagccatttacattaatttgtacattgtaaacatgttaatgtttctctgtattgtctcttccaccaaaaatgttatctttgactgattcaccctctccgaatactgggagagaagggttattttggtttggttttaatttgtcaatcccacaagcagttttcagcagatagaaggtatttggagattttcttacatgaaacaatccaagcatacactttataattttttttactatgtttaaattgatgtatacaacacatgcagaaaagtacacagatgataagtatataatctgattcatttctacaaagtaaatacatctatgtgtttgccaccaaaaatctaggtcctacactaaaaaatagaacattaccagcatcccagaagccccagatcaaagtaggcatatgcaagaaatattttgtaatttccaatgtaattgcttctttgatccatgggttatttagaaatacgttgcctaattttccaacatttgggaatacatttgggaatttcctagttacattcctgttatttacttacagtgtaatatcactgtgaagagatatatatacatatatatatgtatatgtatatatacaatctgctttgtgttttctggattaaaaaaagtttgttatatcagttgttgagaattgttacagtctcctactataattatagattgctctattcttcacttagttttgtcaatttttgctttactgaaattaagtctatgatttaaggtgaatacaaatttagaactgttatatctttttagtggattgacccttttatcattataaaatatcctgtttaccgctggtaatattttttgccttaaatctacattacctcatattaaacaatttggatgatatattttcagatatttttggcatttcctgaacaatgcaagcttcttagaagcttcaaatccaatgataccctctccatattttatatcattgttttgggggggtggtattttaattctgcataaattttaaactcaaaacaatattagtagcatcatattttaatatcactttatagggtcaatattaatttatatgtctactttttcctcattactttctgaattttcttgcttcaatctaggatcatttttctttgcctaaagaattcacttgtattttgttttctgcaaatccgtcattttttgtctaaaaatgtctttattttgtctttacactgaaaggataattttacttggtatagaatttcaaaattgctgtaatttgctttaattcttaaaaaatgtcactccatttattctgccttccataacttttattcaacttctattttagattcagggggtacataagtaggtttgttacatggatatattgcatgatgctgatgtttggggcatgattgattccatcacccaggtagtaaacatagtacccaataaatagtttttcaacccttgccccatccttctttaccccctccagtgtccctagttctattgttgccatctttatgcccatgtgtacctaatgtttagctaccatgtatgtgtacatgtagtatttgggtttctgcttttgtgttagtttgcttagtataatggcctccagcatcactcattgttgctgcaaaagacaggattttgttctttttttattggtgtagagttttacatggtttgtatgtaccacattttatttatccagtctaccattgatgggtatcgaggttgattccatataacaaacctactcatgtaccccctgaatctaaaataaaagttgaataaaagttatggaaggcagaataaatggaatggcattttttaagaattaaagcgaatcacagaaattttgaaattctacaccaatcatgggcattgaggttgattccatgtctttgccattttgaataccactccaatgaacatctgagtataggtttctttttgggaaaaatgatttattttcctttggagatatacccagcaatgggattgcttggttgaatagtagttccatctttagtcctttgagaaatcttcaaactgctttccacagtagttgaactaatttatattcccaccaacagtgtataagcattctcttatctctgcagccttgccaatatctgttatttttctttttttaatagccattctgacttgagatgatatctcattgtaactttgatttgcatttctctgataattagtaatgttgtatgtcttcttttcagaactgaacaaaataaagatctatacaggaaaaccaaagtttattttttgtaaggataaaaaagatcaatagactactagctagattaacaaaggaaaaaagggagaagattcaaataagcactatcagaaacaacaaagatgacattacaaccaatcccacagaaacacaaaagttactcagagattattatgaacacctctatgcacacaaacagaaaatctagagaaaatggataaattcccaggaatgcacaaccttcaaatattcaatcaggaagaaatagaaaccctgaacagaacaataacatgtgccagaattgaatcagtcattttaaaagactaccaaccaaaaaaggcccaggaccaggtggattcacagccaaattctaccagacatatgaagaagagctggtaccaatccttactgaaactattctagaaaataaaggaggaggactgcttctcagccctttggctaagatcaagtgaaaatcaaggaggagagactcctccctaattcatttgatgaaatcagcatcagctcaacattaaagcccagcaaagacatgataaaaaaagaaaactacaaactactatccctgaagaacacagatatgaaaatcctcaacaaatactagcaagctgaaatccagcatcacatcaaagtgttaattcaccacaatcaagcaggtgttattcctgggatgcaaggttggttcaacatccataaatcagtaaatgtgattcacgacatgaacagaattaaaaacataaatcatatgatcatcttgatagacacagaaagatttcagtaaaatccaacatcccttcatgataaaaaccctcaacaaagtaggcattgaaggaatgtatctcaaaattattggcaccatctgtgacaaacccacagccaacaccataatgagtgggtgaaagctagaacaattcccctattctccttaataactagaacaagacaaggatgccattctaaccactcctattctactgagtactagaactcctagccagacaaatcaggcaagagaaagaaataaaatgcatccaaataggaaaaaaagtcaaattatctttctttgctgatgacatgattttatatctagacaaccctaaagactccatttaaaggctcctaaaactgataaacaacttcaataaagtttcaagatacaaaataaaagtacaaaaatcagtactatttctatacactgataatattcaacctgagagccaaattaagaacaaaatcctatttacaatagcaacaacaacaaaaaaatacctaggaatacatctagccaagggggtgaaaattttctgcaaggagaactaccaaacactgctgaaagaaatcaaagatgacacaaacaaatggagaaacattccatgctcatatattggaagaatcaatatcattaaaatgaatatactgcccaaagcaatctacagatttgatgttattccttgcaaactgccaatgtcttttttcacagaattggaaatatcaatcctaaaattcatatggaacttgaaaagagcccaaatggctaaacgatcctaagcaaaaataaaagtcagacttcatcacattacccaacttcaaactatataacaaggctacagtaaccaaaacagcaatggtaccagtataaaaacaggctcatacaccaatggaacaaaatagagagcccagaaataaacccatatccctacaaccaatcaaccaaccaactgatctttgacaaagtcaacaaaaataagcaatgaggaaaggactttctattcaataaatggtgctgggataactggctgtgcatatgcagaatgaaactaaacctctatctttcactgtaaacaaaaataaactcaagatggattaaagatttaaatgtaagacctaaaactataaaaatcctagaagaaaacctaagaaataccctaatggacatggccttagcaaagaattttgactaagtcctcaagaacaattgcaacaaaaaaacctccaacatttacaaatgggatgtgattcaactaatgagtttctgcacagcaaaagaaactgtcaacaaagtaaacagacagcttacagaatggcaaaaaaaaaaacttgcaaagtatgcatgcaacaaaggcctactatccagaatgtagacagaacttaaacaatccaacaagcaaaaaaaatgaccccattaaaaagtgggcaacagacataatttgtgttgaatgaagtctgcattttatgtctttttctttaaaggttaaatgtctcttttttcttctgtctatatttaaaatttttacttttatcttttaacagttttactatgttttacctatgtgtagttttattttattttattcttgttggggtttgtcaagtttattgtttctgtgggttagtgtttatcagttttagaaaattctcaaccattatctcagcgaacatgactcctaccttattctgcacttcccttctatctgggctcttggctgcttagggcttcataacctcagttactctaaaatcccttctgggatatttttaaatcattttatgcacattatctggttctctgcaaaaggatcaatctgatctaagctaatcctccatagccagaaggagaacatccccgtttgaggtgatacttcttatactgtcataatcctagccatagactgaacacataatatacttatttttacttagacatagtcacatatgtgaaatgtgagccaaatttaagttatgtaaaaagataataatgttgagcctattaagtaacattaagatctgcagtcctagtcaccagttgccctaagtgagagtactagggcaatgtgacctcactataaacccgtgcatgcttgaggggctgccaaatcacaagctggagtcagtggggggtgggagggggtaaagctactgccagaaatcccaagccaaagggaagcagaggaagggagccaggtgaaggaagtagcagcgtggcatattgtgtattggaagatatccagaagcactttggggccctcacaggctacttcctcatccacagatgatacccaggcctccctctaaaagcagataactttttgtgtctaagcttcagatttcttaaaatgataatcatgaataattatattacaggctggtaatgactgtaaataataaatatgcaaagtgcttagaatagtgtcttattcagggtaattgcttaataagtcagctatgataatggtgatagtgataataattattgtgtttaagatattgatgattgtgatgatggtcataaagtaaaaatgattatcattaccatgaagaaagaggatatcatatatatagtatatgtatatatacactcccccaaaaagtcagctatgacatgacagaatgctagacttccccttttaccttgaccttaatatacagtaagtatgtatgcttgaaccatcccaaaaccttccctcccaacccctggtccatggaaaaaaatgtcttaaatatacatacatactgtatattaaggtcaaggtaaaaagggaagtctgatatttactgcttttaaatatgttttctactgtaaagtggtcatgcttctgagcctctatctgattgaactggctgagttctatatcagggcaccagtgccctaaacagggtctctgtgacataggacatgcctccacctgggttctactccactttccctcatacaagtaatgtcaaggagagaataaagctaacttattgtcatagagcttgaagaaggacttcacactagtttttatagctcagagtttcaggatgattaataagcaaggactccaaggagaaacagcacatacttcagaagagacacattcctcattgtggctcttgctggaaaatattgataatagaaagcaattttcccaaggttcattcacataggactagatggattttttgcttcaagttcactgcatttttagaagggaataattaaaaaaaaatctaagtgccacttaaaccaaatgggtaaagcacctagatagaaaatgataaaatcaggacactgccatttctattcatgaatgccttttctgtcttcatttaacttaagatatttttgattgtagagaagtaaaacatgcataaaataccagccttttcagcaagtgataggcaactttgttgatacaaatggatttgatgattacttttcaagctgtagataaagacagaattgatggtgacagggaagagatggaacccatatgggaaaggctgaggaaataaacttgtccaggatgtatttctatgcttttttatgtacaaagaaatatacaaacatagaaatatatatatacacatagtatatatgtataatgtgtatattacatataaatatatatatctgtgtgtacacatacatgtacacacagaaggaaaatatcttttaaattgagagaagaataacagttttcccctaatctggctgaggttaagattctagcaaatatgggctcccattcataagtaaacttgtcccagtgaagacagaggaaattgtctaagaaagccaaagggtcttccactgaggtggaacagagtgacatgggttaggggccccatgcagctgaggattcttcatcaaagtgagttgtgcaataaatgtgcactagagtaaaattacgtaagcctcaaagtctcctctgaaccaccactgtctttccagacttgaggaatctcactttcctctctcatacaactcccatggttctctactcaatagcatctactatgtccctttttttctagtttaatcctcccagagacctagagttttcaaagacagaggcagatgatgggagaaaacgtcctagagcagcggttcccaactgtattggtctgttctcatgctgctaacaaagacatacccaggactgggtaatttataaaggaaagaggtttcattgagtcatagtttagcatggctggggaggcctcagaaaactaacaatcatggcagaaggggaagcaaacagatccttcttcatgtggtagcaacaaggagaagtgccaaacaagagggggaaaagccctttataaaaccctgagatttcaagagagctcactattatgagaacagcagcatgggggtaacgacccctatgattcaattacctctcatgggctccttcccacaacatatggggattatgggaactacaattcaataggagatttgggcggggacacagccaaaccatatcatcaacatttctggcacgaggaaccagttttgtggaagacaatatttctgtggacctggggtgggggttggggcaaaggtttcaggatgattcaagtgcatcacatttattgtgtgcttgatttctattattacattgtaatatttaaataattatacaacctcaccataatgtagaatcaatgggagtcctgagtttgttttcctggaactagatggtcccatctaggggcgatgggagatagtgacaggtcatcaggcattagattatcataaggagcatgcaacctagatccctcacatgtgcagttcacaatagggtttgacctcctgtgagaatctaatgcagctactgatcaagaagagccagagctcaggtggtaatgtgagtcatggggagtggctgtaaatgcagatgaagcttccctcactcacctgttgctgctcacttcctgctgtgcggcccagttcctaacaggcctctgactggtatgggggtagagggtgggggtgttggagacccctctcctagaggaaaggaaatgcaacagactggctttcttcttggaatcccctcatcagttctcagttttctcatctataataagaggagtttgaactataattatctgaagtctgccccagctggttactctgggagtctaggatctaaaattggggaaagacgacatgcacatagaaattacattttaaaaatctatatagtgtaggaaagaaggaagccctgaggctgaagcagtgactatgcaactctccttacagaagccatgttcaggagacctcattcccttttgcagaccctcattcacttttttcccctcacccctactcagaatcagagctaatttttcttaggaaagaaactctttccagaagtgaggcagatacaatgctttgcatttttcagatgagaaagctgtgagtcacagttgagtaatttgtccacagtgacacagtgtatctaataagtggtagagagaaacaagtaggagacagagacagtcatttgacagaatctcccttcccttgaacccttgtgtcaagagcttctgggatcctactttcaacactggtaggctggactgcttttggctgaggtgagttctctctaaagccatcttgctgaccatcactttatattggctgacctctcagtttcctctctgtaaatacaagcagcaatatctgagtccatgcctcccagggatagtaagataaatgagataataaaggtgagaaccaaatgagctcctcttaatgatggtgttaaaaaccccatgaggtactgtgatgttattaacaaaatgcagaggctgcagagttacatttggccaaattcttacacctctcaattttttagcaaggagacatagatatgaaatcagtattcccaatagtgaaactgactacaagtgtgttctcatttttaaacaaacctattctatgcaaatccaattaatagaaaaagtataccaatcaaggatctatacatatagctatctttcacaaaactattctagttttccttattaaaaaacttcaaaacacttcatgctttgtggcatttcagtgaaattggaattgtaaaataatgatttactgaaaaccttttaaaggtactgatctggcatgaagtgaggtacgactgaagtttctagacaaccatttgagattttggctgtggagccctcccaaaagaagattctaccagccagttgcatcacttgcaaatattggaggccgttgctctggaaaagcaactaaaaataatacctgggtgtggacaaaataagaagggagccatactcagctatgagccagtgtattgcaaagggccagtgctggtcaaaagcagtggggccatcatcttgatttagacatactgtccacttctctaatgcaaacccacaaaattgttgactcttagagtgcccacaaagcttctgctgtgacgataggacttttagggccatgaagaagctaacactaacttttacatttcaatttttaccttttcccacatagcttacgctaaaactcttcccaacttgtggcctggagaatgtatttttctggcattacattccctttccaacattattcctgtccctcaacctgttcagtaatcttatctaaaactactggataattcctttgagggtgctatcatagcccaaatatgtcaaggtctgtttttcactagtaaacagtgaacatcttcagttttaaatgataagttaattctacaacttaattgagcccatttatgtttattcattgctgaagttcctcttagatcttgccttctctcacatcttctctataacccaagaaggaacccacctagatctcctggaccccctcttgcctgatttaggtagatcatcataggagatgaaaaattatcatctcaaatttaagttttcaagagatggtatcaaaacacgcttttgtcaacaagcccaatcatattcccacaacttttgagtgctcttcctgattctagagcaaacacactgatttagatagagcaccatgtttctgaaccttgaataatcctgttcagattgaagcaggggtgtattaatagagcgcaggtcttggagttaaaccacacccgccctcacccccaaccccaccaccccacaacaggcttaggaaggttgctcaacctctcaaggcgaaggcgtttgctgtttctcatctgtaaaacaccaaagattgccatccccatcactgttgtggaagatcagcgagacataaagtgcctgtcaggatgtttggccaatagtggtacctgattcagtcattcagtgactttcacagtcaccttgagcttgactctctcaagaaaagaaaagaaattaagaagcatgtgagccattgaaccttgaccacaaatattctaagaaacttataactccttagccatatgtttcatttcaaatccaagtatgaaaaaagctatgtaactgaactaaaaagtggatctactctataatttattgtattataatacatatgtatacatctcacacactgtgtatttatactttaagagagaaagacttttataagactttttacgtcaagtgagggcatctgttcatttctgtagagcacatactgctttgctgcagagtgcagagagaatgactttgctcttcataccctaaaattgagtccaccagggatgaaacataggcgtgtagtagcaaaggcttctgtccagctgagcagtaaatcctggctgcccctgatgatcacagggactggctcctggtaataattttgatgtcattatcctctcctagaaatgcatgaatggttctggcctttaaaaacagatttaagaggatgcatttatcttgaccttatcagccttttaaagatcatgccgtagggcctgttgacctttctctcttaacgatgagttgcaaaacagtgggataacatcaatggatgaaagggagaaagagtgtgtaaccagaagcagcacccatggagaggaggaggtgggacagggatgttcaggctgacaaaggaaacttgctttagtcctgtgggaattgaagaatcccacataaatggaagcacaggaggcacaaatgggattccatttccatctctgctctaaatatgcagtccttgggtactgtgatggttaattttaggtttcaacttcactggaataagcaatacctagaaacttggtaaagcattatttttaggtgtctgtgaggggtttttccaaggagattagcatgtgggtctgagtaaaataggtggggaagatctgcctttgatatgaggaggcaccattcattcttccaagtccagaaaaggcaaatgtgtcaatctatctgctgaaactgggatacactcttcctctcttgttcttggacaaaaacttcaggctcccagcctttgggctccagaatttatagcagcaacccctttccccacctgaggctctcaggtctttggtcatggaatggggattgtcataagcttccttagatctaaggccttcagtcttggactgagccacactactggcatcccagggtatccagcttgaggatatcatgggacttctcagccttgataattacatgagccaatgcttttaataaatctcttctcatttatccatacatattttattgattctgcctctctggagaaccctaatagaggtatacatcaaggcataagtcaagaaaaataagatatttggcttattaagtggttggcaatgacttcaactcttttttttttttttgagatggagtctcactctcgtgcaggctggagtgcagtggcatgatctcagctcactgctacctccgcctcctgggttcaagcaattctcatgcctcagcctcccaagtagctgagactacaggcatgcaccaccatgcctggcgaatttttgtatttttagtagagatggggttttgcattgttagccaggctggtcttaaactcctgacctcaagtgatccacccacctcggcctcccaaagtgctgggattacaggtgtgagccactgtgcctggctgtgactccaactctccaacgggtaaagcacaaacacatttacttaactgcacccaatcttgtgaattttgacacttttaaattataggtagtgttcaccaattcaccactgtataataggaataacatgggattctgtgactgttcatgtaaaggattcatataaagctctatcattttctagtagagtttcccaaaatattttttaaaaatatcaagggtttctaacatctcaaggattaaagacaataataagtaaagagttcttcacacagttctttggtgatgccatgtgtttaattaatgctaatatcttctcccattccgccaaatttccctttgcaataagttgctcaatcgataaatcaaatgatgaaaaaaagatacagttgataaaaattagaaattgagaatgtctggcttccctgaaagttttgagatctagttaccgtgaccacatatttagggcaatacagaattttaacagagggaccaaaatttgaaattgaaagcactctgaaaaaatacaagagctgccatgagcacagtaaagatctctaatacacacaaataaaaatcgagtaagttaaaagcaccggcttttctgccctctcaacccaaggaggtcatatcaatgcacaaactaaaatgcacaattctatgcttacccactatcactacagcccagtgaatgctttaaatcccagacatggttaaaaatatagctggttatgtgattttctattaaacctaatatagtgggatgaaccataataccttacaggagcagatgaactagtatttccaaggcaaccaaaggatatcaatatcactttattattattattattattttcattctgcaaggaatcttccttgaagagcaattccttttatgcattggtctgcttgatagctttctgaataactgtaatccataaggctttgtacctctttttgcatgctggaaacactctgacttaatctaattatctcatgaaacttcactcttaaataaagcttgaagtaaaattagaaagcagcctctttcttttcctttagttactgtcttcatggtaccttcctcttggccggttgctcataagaaaatgggctatgcctctgcagagaaagcattctttacacttctctctggcaaggagaagttgggtttgggccaagtcgggccccatgaaaagagaataaaatatgactggaaaccttccttctgcatgacaaaggagtggctggctagaagcaaacatttattgagcaaatattggaagtcaggcacgttgaaaatatcactggtctaagagatctcagatttgccagggagaaaaatgggccaacatgggatgtcaatatactccaataaagcctataagggtcagcattgattcattatccaaacagtgtgacatttgagaatgaaaggggagcatcaaaaattctgcaaggacaactgacataaacattatcctaattaggatctaaatgtcttgaaacacaaaggagaaccctaattgaagtatacgtcaaggcatgagtcaagagaactaagatttttggcttactaagtggttggcaatgactccaactacaacatggatttggaggaaggtgggccaccagaggtttcagagaaatttttgcgttgggtcatgaaggaaaaatagatgttgttaagtggagaatcagaagaatgtttcatacaaaatgaaagagcaaggacaaagatatagagtagtaaaattggatactgtggctcataccaatttgaacccagagaaaacaattagaagatttcatttttccccttcatattgaaaaaatacaaaagactgacaatgccaagtactcataaaggcataggttaatactccatgtataggtagaactaatttggagaatatcaccgaagtgtctaataaaattgaagatgcatatgccctataatccggaagtcaaattcctgatataaacccacatgtgtatccaagaataaaaaagaacattcattgcatattgtttatcatagcgaaaaattagaaataagttttcatgaagtgcagaatggaaaaataaattgtagtaaatccatttaatagggtactattcagcagttaaatgaactaaaacccaatggatctatcaaaataaataagtctcaacaaacatattaagtggaaaaagaaaacaagctacagaaagatatgttctataagataccataacaataaagattaacagcatggaaatagtactacaaactgtttaatgtatacattaaaaggcttgcatggctactgtacataatgctgcaatgaacatgcaagtgaaaatatctcttttgatcaattatatacaatagggtttgcactcctaagagattattcagcttttaaaaagaagaaaatcctgccatttgccacaacatgaatgatcctagaagacattatgctaagtgaaacaagccagatacaaaaatacaaatattgcgtgatatcacttatatgtgaaatctaaactagtcaaactcatagaagcagagtgaaatggtggttgacaaaaattcaggaaggggtaagtgaggaggtattagtcaagggtacaaagcactttatccgcacttggaatatacaagtcctagaaatctacagtacaggatagtgcctatagttaacagtattgtattgtatacttaaatatttgctaagatggtagatcttatgtaaaattttcttatcacacacaaaatagtagaaataataaagagagcagaaagaaacttctggaggtgataggtttatggcatagattgtggtgatggtttcatgagtgtgtatttatctctaaactcatgaagttgtatatattaaatatgtacagcctatgtcaattatatctcaaagttttttaaagcttgtgtgagaatgcaaatatagagtcttggacagtggtttgatctaggtagaaaagtaaagaagagaatcaattaagatgtacatagttgcctttaactgtgattgtatctttatttcttaaaagagaagagggaaatgtgacacaaattggcaggtttttagatctgatagagctgggggatggttacataggagtcccctctattttatggggagattagtagggatctgaagccaagctgtctgagtccaatccagtccagctcaaccacttcaccagtgcgtgacaccttgggagaatgattttacctctccaagtgtcaactcctttcctataagatatggctaataacagtgctacaatgactaaatgagttagtgtttgaaagctcttagagactacaggaataaataagtgatggtgaaataaaaataaacaatgtattgcacagctcaagtaggtagaggacaggagagctgggatgggtgatgataaccttacttcaatctcatttttcatgacaaggaaactaaggttaggggagtagaattaactttgattacaaggtagaagcaatcagagatatcacactgggctcacaacaaaagaactgtataactggaaggctccttggtgatcctactgatagggacaggaggcagagaaattctagccagaaaagggtgagtctctggtgaagccccaccttcaagctgaaaagcctgaaacaacagcccaaagtgagaaattctatcgctgtttttccacttgaatgtttccttttcataaaccacccatggccccaccatgcctcatcctgtgcctataaagaccccagagtcagccagcagagaggaggagcagctggatgtcagagagcagcagcttgacttcagagggatggcttgatggagtaacttcagagaataatctggccagagatggctagacttcaagggaagattacctaccctctcatccgtccccttttcagctccccttcccagtgagacccactttcattggcaataaaatctcctgcatttaccattcttcaatttgtgtgacctcacttttcctggatgctgtacaagagcccaagagccatgagtgtagatacaaaaagctgtcacactggccctttgcccttgctggcagagggcagctgcctcacacaaaaaaacaaaagactcactgagctgttaacatttaagccatccacagatggcagtgctaaaagagcactgtaacacatcatctggggcttcaggggtcacaggcacccctacctggatgctgccgtggggcccacatggagttcactcctgctggtgccgatgtgtctagtcagttccaacactcatgcactccagttcctgcctcgttcgctcatgcactctctcccatgaggagttgagggcggtgggctatgtaaatgaggcattcctgttgtgagtcccatgaaggggtcagggaagtatcctgcttcactagcatttagtacagaagttgacaaaacttttccatagaaaaacaggccttgggtaggatttggctcatggactctcaggctgtagttggccaacaccttgtctaggggttctcaaatattctatgcatcagaatcacctggagagctagttaaacacagattggtgggccccacccccagattttctgattcggtaggggtggggcctgagaatttgcatttcccacgagttcccagaggatgttgatgctgctgggccaggggccacatgtgggggtgtccaccgttataatgtaactttctcattttatacttgaatagaatgaggccaaactggatcaatgaatagaattgatccaattttgttaagtgagatcagacagcaagtaaaagaatttaggcttcattcgaaatcttgtttattttaaaataacatataaagttacaactgtatcctgggtgctgtgctaggctctgggtatataaagataaatgtgacatggtccttgccttccagaagcttgcagtatagtagaagaaatgagataatagatgatacagtatgtaagactcctgggagcataggaaacattgggaccccagagaattacctggtttcttgaaggaggggccacctggagtatcttgaagaataaatagtcatccaacaggaaaaataggcaggtgaggggaggaaattccaggtaaagggaacagattgtgtaaggcataagagaagcaacatggcatcatgcttcacagtaggaattctggctctgctacttactagcctgggtcagttatttaacctgaaaacctcagtgtcttcttccaaacatagggataataaaagaactgaccacctagggttgatgtgtgaattacataagataatgaatgtatagtgttttggcctagtgcctgaaacacaattagtccttaataaatatgggcaattgttatttgtgttattattatagccagtgatgtatcagagcatgatacattcacagtcattaatgaactaaagtatgaggtgcaggtggagctactgaggcgggcaaggccagaaaatgaaggactctagtccctgcctgactcagggagggcagtgagcagagagtggcagaagagtggcattctaaggtctccattataattgaaggaggagagaatgattaagacaagtgatgtggtaaccaagaattgggaaaagattttgaagaaaagatgatgaggtcaattttggaaatcagtgggatatcgaaatggaaatgtctggaactcaaaagaaagatcttggctacccaaattcgaaatccctgggttggcagttgaatagatggaagtgaaatatcaccctgcaatattatgtagggagaagagagttcacaccaatgcttaaaaagtcagcattgagaagtagaaaagaagtagaaaagaagaatcatgagacagcatccaagtagctaagagagaataattttaaggaggagttgcagtcaacaatatagaatactccagagatcaagcaagataaagatcagtgagtaacacctggatttagaaccaggagaggcaacttagacctctgctttatactaggtggaatgcattgtgtacatttcataaagaaatatatatttgcatataaggtaaaaggggataagcagaaattaagtcaaagagcaatttttctccccataatgaacaaaataccctcctcctaaaaacctcaagaataaagatttgaaagctttactctcaccctctccccaaggacattccaagccctctgtgatccccagatgacactagaccagcctcaactcctctgacatttttatgaagattgtcttaactatgcagagtctgtattttcccaatacacaccgtgacttttctagcctctgtgcctttggtcatcctgctccctcagtgaagaattcccttaacttttcctaaaataaggaaataattctctcataccttaaagcttgattcttgttccataccagaccctcattatcttgcccacctactactatcctctggcccaaaactctttatagcattttttttttcacaacctacactccttttatttacctcctcaattcctcaaggtgaaaaactactccctctctgttggtgtgtattctatccaattgtttcgttgtatccaagtgcctggtatacagaaggcagtcaataaacagtattgaaaggatggaggaaacaggtatcatgcttaaaatgcatttctaaataattcaggacaagcaaaagaaaattaattaagaagttatgcacataaactgaacaactgagtgggatacagagaactgaagtttacagagaggatgtgggagaggggacggcttacgaagaagaggaaagtaaccaggtatctactaggcacacttgtcaaaagtaattttatcgtcacataaactttaaaatactgttatcgttcccatttcaagaatgagtgcacagaagcttggagaggctaccaatttttgcccaaatagagcagcttatgtcagtacaaaattgaatatgattcttacaatacttcaggattctgataccatgttgctttttggaattagaatacagaagactaaactgaattaaacactaaagcaagatgtaaatagagacttggcatccattaactgatctagtaaatggcatctgtactgctgaggcaataacagatacgtgtataaaaaatggatttataaaggagagaaatcagatctgtctcatctacttgcctcatacaattgtgatgagaagcaagtaagacaatgtattttgcaggcattttgcaaaactggaacaactctctgtatctaagagacaataagttataggactcctgacttcctccctgctctacactctttaaacatttctcttgccaattttttgcttatcctttcctttttgccttaatcatcaaaacatgattgcaattaagacttggtgtttctctgggtcctgtttcgaattattttaataacatggtatatttcaagaagtatttcaaatagtgtcatagaaattttgactaggggtcagaaggcctgttatttctcttggcctcactttctttacctgtaaagtgagagaacggaattaaatgatttctaaaatttttcccaactcatgcattttataattatttactcttctgaaattcctgtgataagggaagtgtagattaattctcccccatcttgacaatttggttcttaggaatctgagaatatctttattttcttgttcttgatatgattccaagaaagcaaatacgtattagacaaatttctctctgagtattattattgtagcactgaaatccaggatgagtaactttttcctctaaatattagattaagttcctattctcactgttgacagggattaaaaaaatacttccattccacacagcaccttttgtcagctagaagctgatagaaaatttcaggggagaagtgatcatcttaaacagcaggccctggctttaattcagggaatgaaagttacattgattttttttaaagtgatctgaaaccagcaggaatctctatccaaagcccagacagatggctgaaccaatgggctccctgtgatcatctctgctacccatatatcatttgggtagaaaataaatgggttttaaattacctttagttccagatagacctagaaattaaatctctacacatttgaaaaaagctaataccaccttaagctgcattaatagaaatcaatttctttgtcatgggaagtaattgactcattcaccctatatttaagttagaatattcatttcttttaatcatatgctaagtgtaaaagtaacacattagagtttgtccaaagaataatgggtagtacattaagagggtctgaaagtcatgttctctataagacaacagaggattgtaattcagataaaagacgatttaagagagacctcataatggtcgtcaattattaatatataatacagtacattctatgttattcaggaggacatagcagataaacaggaggaagagatatttgattaaatggtacagagaagattccaaaggatcaagcaatcctgagttagaacaggtcttctcagaaggtgacactgactagacacacaatgtgtgaaggagtgggcaaatggctatcagttggagatgatatagctgggaagtaacaaatattctttataaaattaagatcccctttttcctttcttttttttcttttttttttttttggagtcattctcaagtcactttcaaaatcaataacagaaaaaccaccatctcccctggaggaaagacatgggctctcatcttcatctgtaaacatggaaccctgatatcaggttccataaatatctgctctatttatgagtgctcatgtttgttttccactagtggtatcatttttattacaggtattaggaccctcatatccttttctatgatagcaatttgctctctgtttttccttgaaagccttctctgcattctagagatgttgaatgtaggtcttcaaatagagaatcattaaagaaactttcatttcagaccaccatggaatgacagggatgagattaccctcatgccttaaacaattagataattagtatagatacataaaaagtggttttcagacattggacagcaggctatgcaggacaatgatccctgaaagaagagaaacaaacaagatgacccttataaatggcccagagcatcatctgaaaaaaatgtttccagatcaaagcacagagagggagaacccaaaccgaatccagtagcctcactgagtggaggggacagagttcagagttcggagagaccaaggcagctagaaatcatggtgcaagttactgaagaggaaggaactattccaagatggactgccagaaatgtgcagatgggtcttttgagtctttggctgagggtgaatgttagcatgctggagagaagaatacccaaagccaggggagaaaactgaaaagaggtaatcacaacaatttctgaaggtcacaaagggctgggaagagtttgtattcccaacaggtaaaggggcaatacacaggtaaataatacacacaacatcaggtagaacccatgaaagggcatggtcttggtagaggagctaaattagccttagaatgatttctggaactaccctaatgaagcaaagcttccaagcctacaagagattccaagtagcttaactgcatactagaagaaaatccaacactagaaaaggaatatgacaaaatccagcaacccaaaaagtaaaattcacaatatctaccatcaattcaaaatggcaagacatacaaagaagcaagaaaagataacctgtgcccaggagaaaaaccaatcaatggcaacaaaagcagaaacaacacaaatgatacaattagaagacagaaacattgagattgctattatcatgattttccatatgttcaggaagtagacaaaagcatgagcatgattagaagataaatggaagctttttactccccagctttattaaggtataattgacaaataaaaattgtatatatttaaggcacacaacatgatgatttgatacaggtgtacattgtgaaatgattaccaccaaattgataaacacatctattatctcacataattacattttgtgtgaatgtgtggtgataacacaagatctactcctttcgtgaattaaagtatacaatatgatattaagtatagtcaccatgctgtacattagatactcagtacttattcatcttgtaatgaaagtctgtactctttgacgaacatctcccattttcactgtgctctgctcttttcccttctccaggctctgacaatcaccattttaccctctgcttctatgagttctaattttttatttcacatataagtgagatcatatagtacttgtctttctatgtctggcttgtttcatcttatataatgtcctccaggttcattcatgtcgtggcaagtgacaggattttcttcttttttacaactaaataatattcctctgtgtgtgtctgtgagaaaatcacatgttctttatccattcatccatcaatggacacttagattgtttccatctcttggctataatggatagtgctccaatgaacatgacactgctggcatcttagagatactgatgtcatttcctttgggtatatacccagaagtgagacagcaggatcatacagtagttcaattttaaagttttttgaggaatatccatactgtttccatactggctgtaccaatttacatttccatcaacggtgtataagggttcacttttcttctcatcctcaccaacgtttgttatctcttgtctttttcataatagccatcctaacaggtatgaagtgatgccttgtggttttaatttgcatttctcttatgattaatgatgttaaatgccttttcatgtacctgctggtcaattgtatgccttttttaaaaaaaacatttatctagatcatttgcacaattttaaattaggggtttttttgtttgggttggttgctattgaattgtataagtttcttatatattttagatattaaccatttatcagatgtataatttgcaaatattttctcccattctatagtttgccttttcatcttgatttttttctttgttgttcagaagattttagttttatgtagtccaacttgtttatttttgtttgtgttgcctgtgcttttgatgtcatattaaaaaaatctttggcaagaccaatatcaaggagctttccccctatgtttacttctaggagtattagtttcaaatgtcacatttaaatctgaattcatttcaactttttttatgtgtatgatgtaaaacaacggtctaattccattattttgcatgtgaatacctatttttcccaacatcatttatttaagaaactatcctttccctgttgtgtattcttgacacccttatcaaagatgcgttgagtgatgtgcataggtttatttctggtctcttagtctgttctattggtctgtttgtctgtttttattctagtactatactcctttgattaccagagctttgtaatatagcttgaaatcaggaagtgtgatgcttccagttttgttattgtaatgcaattttgcattggatattcagagctgtttgtggttgtatgtgaaatctaggattgtctttctgcttctgtgaaaaaatccactggaattgtgttgaatctgtagataacttttcgtagcatgagcattttaacaacgttaatccttccaattcattaacacagaatatcattctatttatttgtgtcttcttccatcagcatctcacagtttgcactatagatcttttatctccttagttaaatttattcctaagtattttattctttttggtgctagtgtaaatttgattgttttcttaatctcttttttgcatattttgttgctaatgtacagaaacaaaattttttgcacattgattttatatactgcaactttactaaatttattagttctaacagtttcttggtggagttttagcatttctataaataagattatgtcatctgcagagagagaccatttagcttcttcctttccaatttgaatcttttatttctttttcctaattgctctggctagaacttccagtactatattgaataaaagttgtgacagtgggcattcctctcttatttctgatcttagagaaagagctttcagcttttcactgttgtgtataatgttagcagtgggcttgtcatacatggcctttattatgttgaggtacatttcttctatacctaatttgttgagaatttttattatgaaaggatgttgattttgtcaaatgctttttccccatctattgagataatcatatatttttcataatccattctgttatgtggtacatcatgtttactgacttctgtatgttaaaccatccttactttccagtgataaatcctacttgatcagggtgtatgattctattaatgtgctgttgaattcaatttgctagtattttgctgaggatttttgcatctatgttcagcagggatgttggcctgtaatgttctgttctcttagtgttcttatttggctttgatatgaaaatcatgctgccattgtaaaattagtttgggagaattctgtcctcttcaactttatcaaagtgtttgacaaggactggtattaattcgtctttaaatgtttggtagaattcacccatgatccatctgctcctgggtttgtctttgataagaggtttttgattactggtttcatctcttttctcactattggtctgttcagattttctgtttcttcatggttagtcttgagaggttgtatgtttctgggaatttattttttatttttatttaagacagggtctccctctgttgcccatgctggggtacagttgcatgatcattgctcactgcagcttcaacctcctgggctcaagcaatcctcccacctcagcttctcaaatagctgggactatgggtgcatgccaccacacctgactaatttttgcattttttgtagaaatggggttttgtcatgttgcccaggctggtctcggactcctgagctcaagccctccacccacctcggcctcccaaagtgctgcaattacaggtgtgagccacagcacccagcctgggaatttctttagagaaatggaagctttccaaaatatacaaagggaacttctagacataaaaaatttaaatatctgaaatgaaaaaatatacttcatgagattagtagcagattaaatactgcagaagaaaagatcttgaactagaagaaacagcaacagaaactattaaagtgcaaagagaaataaagaagaaaattgaacagaacctcaacaacttgtgaaacactatcaagcaatctaagatatgtataactagaatcccagaaggaattgagattggaaagtgggtgatggtaacaactgtgaagaaatcatggccaaatctttccaaattttatgaagacctataaatccaagaagctcaatgaaccataaaaaattgaacataaataaaaccacaataagatgcatcataacaaaataaatgaaaaccagaacaaagaaaaaatcttagaagtgggcaaactaaaaaatatattacatacagagatacaaaggtaagaatgctagtaaacttacttaaaactacgcaaaacaaaactaactgatgcaatatcaaatacagaaaaccaaccatcaacctacttagattttattatctagtaaaaacacattttataaataaaggttaaataaagcccatttcagaaaaaaatatataaaaacattcattgccgagagctctgcaatatttcaaagaactatttaaggaggtactaaaatcgtatagaaaatgatagctttatagatggaaatttggatctacacaagggaataaacataaaagttaaatatttggataaatatgaaagatttttctcatttttaatttcttcaaaagataaattatgatttaaagtgaaaataacaattgtaatacagtatataacatgagtaggaataaaatatatgacattaataccacagagccaagaggagggcaatggaactatactgttgtaaggtttccatatgctaataagagtgcttcaaaataaataaagaaaaattgctagaactgaaagaagaaatatgcaaatccacaaggataattggagatttcaacacacctcattaaataattgacataactatgaaaaaatcagttaatgtacggaagacttgaaaaacactttcaaccaatggaacctaaacgacatgtattttaaaactccaccaaataacagcactatatgcattcatttcaagtgcacgtggcatgttttgcaatttgatcatactgtgagacataaaacaagtcttaaaaagttaagacgtatgacaatcacaacagaaatgaactagatatgagtaataggaatatacctaggaaaattttaagatatttggcactcaactagtgtattttaaataactcatgggtcaaaaattacagagaaataagaaaatagtttgaactgaataaaaattaaatcacacatactaagatttgtgggatgttgctaatgtagtacctacagggaaatttccagcactaaattcttatattaaaaaataatgcatgcaaggtttttagctttcagcttaaaaaactagaaagagcagagaaaactgaacctaaaataaagaaaaagacataataaagaaatcaattaaatggaaaacaaagaaaaaagaaaatccatgacaccaaccaagaactgttcttttgagaaattgacaaaattggtaagcttctagtaaaaaaaaaaagaatttaataggaaaataatatataaaaggtataaattatcaacagtacaaagggaaggaaggaatttatcactaagattctacagacaccgaaagtatactaaaaggatataatgagtaatgttatgctaataaattttacaacttatatgaaaatgacaaattccttgaaaatactttctaccaaagcttactgtagaagaaataatctggatagtcatataacaattcaagatattgaagtagttataaatctttataaaaattgtgtaggcctagatggtttcattgatgcctttctaccaaacatttaatcttctagaaaatagaagatgatggaacactttacagctcctttcagaaaccagacacagaatcaccttgacactaaaaccagacaaaaacattatatagaaaaaaaacttttagaccaatatacctctttaacataagttcaaaaatctttaacaaagtattagcaaatggaatacaacaatatattaaagaataatatatcatagtcaagtgcagttcatcccagaaataaaaggttggtccaacattcaaaaacaaatcattaattcaccattttaacacactaaaaataaaagaccacacagccatttccatagatgcagcaattcctctcctaggtatttaatcaagagaaatgaaaacatatgttcatacacggactttgcagatgaatgttcataagttttatttcagataaacaaaatctagaagcaactcaaactgttcatcaatatgtgattgtgatgtatgtatagaataaatcactattcagcaatataaaggaatgaactgctaatacagtcaacaatataacatggatgaactttaaaagcaccatgctaagggaaagaaatgctacaaaagattatatgcatatggttctcttaatatgaacctctgggaaatgtaaaattgtattggtttccaagggtgaaggggtcagaggagttcctctactacaatgaggcacaagggaacattttgggatcataaaaatattacatatcctgcttttacagcactgtatacacttgtgaaaactcacaaaattgtaaatttgaaattaaagaattttactataagtaaataatatctcaacagaatagatatttaaaagactataaggttttcacaagtcttaaattttagactataaactctcaacatctccctttttcctaagtcttttaaaatgaaagttcaattttaagaaaagtttcacacaaaagtaattcatgcaaattatttttaaaaatagaaaatgtagaaatgtacaaaaagacaataactatcatccagagataaatacttattttttgcagctttccttccagagtttttcttctatagttatgagagaatataaaaaatttaataatactgtatatgtgattcaatatcttgcttttatcactaaaactacaaaattaaaacctaatatatggaatttatttccctgattagaaaactcagaatatctagttcataagtattgcaaaataactctttccaacttaaaaaattccagttagaaaatatgttttatggtgaaacaatattatattagtaaaataaaagcctgaaaaagtttcatttggtcttatttagatgaaaacaaatgaattttcaagacttgcttctcatctatacaccaatggctccatccaatctcccacacccacaaaaattaaaaaaaaaaaaaacatttgtttttggttttattttgctgaagcatctgaaaggcagtttgctgagagccaaactgggggaaaaaatgtcttgtttagagttcaccctatctgcaaaagtcttaactttggagtcagtcacttaacattcttggttttagtatatatttcaggaaaagatgtaataaatcactccaagatacaaatgcatctgggaagcagaatcattccactggaaagcaagacaaagggggcagtgctctgcaggtactaatcagatagaaagaagcagctgagagcgatttcttgcatctgtttatcaagtacataaatactttaagcacctactgttagccaggcaccgtgcaggcagtatagcgggtggaaagatacaaattacttgccctctaggacttgacagtctgtacacacaaattcctataatgtgatgtctatcgtaaagagtacaaagaaagtttaagaattcagaattgaatttgatcattttcagctgaaacatcaaggagccatgaaagggggtaatctaaagctggcttgtgtggaatgagtcagatttcaacaggcaggtataggagccctcagggtggggtagagtaggaaaataatctgaatatgctgagaggcatgacaaagctgctgagctgagaatgctgaggacatacccagggaagagttaattagtccaggttgacagcagtagctacatgctggggaattgtgactgatgagcttagaagttgaggccaaattgcagatggctttggctaccaggagagatgtgtagacattaccctacaagaaatgggaggtcattgaaggttttcgatcaagggtataataggatgctgttgtgctttgattagtcttgttgcaatgactaaaaaatgattgaagaaaataaaaacaaggtaggggtttatcacaatattctgaaagcctgaaaccacaatggtagcagaaggcataaaataaaatgacatatataagaattattttgtagttaaaagctatgagtttgagcaatattgactttaagtggtgggcgttaggaagaatcaagatccagaaggctaaacaggagcagaagtactttcattgccatctcacatattcacttatgattgcgagagtctcactgaatccaggtgtgaccacaggatgctcagaatagtaccatggcagagtactcagaatgtgaattctgcagctggactgcctgggtttgagtcctgattctgctacttactagctatgcggccttgagtaagttactaaaccagcacatgcctcctctcataaaatatggccaacaatcataataattcctttatgtgaaagttaggagaaataaacaagttaacatttgcaaagtgcttggagtcatgcctggcacaaagtaagtgttttacaagtgtttgttaaaacaaacaaaacctcactatgttcacatagtcctatattaatgtgagttgccattgtgggtgaaacttttggcatctctgcccatctcctaaagcgttgtcttttctttgttcttaatcttttgtttgaaagctatattttctctttagccaatttcattcactcagtggctataaatatcatttgtatgttggcaggagacaaatgtgtatgtcccctcagacttctcctgccaacaagatgccttcttttgaaagtttcacaagtgcatcaaaattagcatgactaaaacagaatacatttatgtgctgcatatagatgtttcagtcagtggtggactgtatatacaaccataatcctataagattatactggaataccatatgttttactggcccttttctatgtttagatatatttggatacacaaatactcgccattatgccacagttgcctacagtattcaggacagcgatatattgtgtaggtttgtagcttagcagcaataggctataccacatagcctaggtgtacagtaggcaatgtcacataggtttgtgtaagtgcactctatggtgtgttcacatgacaatgaaatagtctagcacatttctcagaacatatccccactgataagtgacacatgactatttgaatctccccaccccaaacctgaatcacctatagtttaccaattcagacaatggcaccatcattcatggaggtgttgtaaatccaaacttaagattcatccttcgttgcttttttttcccccattcaatacatcagtatgttctgtagacattgtctccaaaacatttccagagtcagtcaatttatcgctctctttactcctgactctccaagtctagtcactgttatttctcaaaagcacttctgtaatcgacatctaagcagtttctctaattccatgcttgcccttttctagttgattctccccacaacggctaaacagattggtaaacaatgtatatcatgcatgccactactctggttaacactctataatcactcactactgaataaagaattaaacctcaatattctcaaatggcctacaaggcctcttcttcccagcttctcattctcttttcatgtccttcaatcccttccttggctttctctatcatcttccaacatgccaagctctttctcacttcaaggacttccaaggtttgtgctccaccttgttgcaactttctaaacttgctggtccactgaacaaattctacttaaccttcagggctcccttcaaatgacatcttcccagcaaggccccccaactcttatttccttcatagaatgtgcatactttgaaaatacgtatttattgtagacttgtttggttgatatttgcctcatctcctaaattataagctgagaggacaagaccatatttgttttgttcactgctatacacccagaccctgtttagtgcctgggttgaaatgtatgttttgacaagaaagaaaagaaaaaaaagggaaggaaggaaggaaggaaggaacgaaggaaggaaggaagggaaggaaaggaaggagggagggaggggaaaaatgaagaatggaggaaatgaagagtgggaagggaggaaggaaggaagaagaaaagaaaagaaaagaaaggaagaaatgagggagggatgaagagagagaagaaaagaaacaaaggaacaaaggcacgtaaaccctggaagacaacctaggcaataccattcaggacagacatgggcaaagatttcatgatgaagacaggaaaagcaattgtagcaaaaaccaaaattgacaaatgggatctaattaaactaaagaacttctgcacagcaaaagaaactatcaacagagaaaccagacaacctacagaatgggagaaaaattttgcaaactacacatcctacaaaggtctaatatccagcatttatagataacttaaattcacaagaaaaaaaaaaaactccatgaagaagcgggcaaaggacatgaacattttcgacagaagacatatatgcagccaacaagtctacaaaaaatagctcaacatcattgatcactaaagaaatgcaaatcaaaaccacaatgataccatctcacaccaatcagaatggctgttattaaaaagtcaaaatataacatatgctgacaaggttgtggagtgcctatacatggttgatgggagtgtaaattagttctaccattgtggaagacagtgtggcaattccacaaagatctaaagagagaaataccattcaactcagcagccccattactgagtatatacccaaaaggacataaatcattctattataaagacacatgcatacatatgttcactgtagaactagtcacaatagcaaagacacggaatcaacctaaatgcccatcaatgatagactggatgaagaaaatgtggtacatatacaccatggaatactaggcggccataaaaaagaacaagatcacgtcctttgcaaggacataaatggagctagtagccattatccttagcaaactaacacaggatcagaaaatcacatacttcatattctcacttataagtgggagctaaatgatgaaaacacagggacacatagagggtaacaatacatactggggcctttcagagggtggagggtgggggaagggaggagggatcaggaaaaataagtaatgggtactaggcttaatacccgggtgattaaataatctgaacaacaaccccccatgacataagtttacctaggtaacaaacaaacctgcacttgtacccctgaacttaaaaggcttttttttttaaaaaaaaaaaaaaaaagacaggcattcaccaaccctgatgagtagccattgacttttgcctctcagacctggcaaggcattgaaacaatggagttaagaaggataaaccagtttggtatgaaaagaggactcacttagttttggcttattatcattcagggcacacatatttactgtctcctccatgcatgcttcccacatgttattacagaaaagatattagaaaagaaatgaatacataacaacttcaataaatatgaacaagtggtacttgtaagaccaggaattttgaggagttttcagaagatatcaagtgaataggatcagatttaataaaataataaataaataactaggactgagaataagctccttgtagtataatagcttttcttcctaaattctcactggctccttagataaaggttaaacctgctgacaaaagtactcggagcagaagcagcttacatagggcaataactagagtacaacctatgaaagccttggctgcttttccttctcctcctttgcatattaatgctaagtttggatatggcatttgctcccatattgaaaccgtgtaaagggccttccagtaaagcaatacagtgtgtatgagtatgtgtgtgtgtgagagagagagtgtgtgtgagtgtgagtgatgtgtgtgtgtgtggtggcttcctactatgtgcctggggccagagagaagcagaccaaaccaaggtaacttcagaaccacacagctgacacagaaatgaaaaaataaggacaattctttagaggactaaaatgcaaccatacatatcacttcctaatgttttccttactttagaaatagatttcaccaacttgtctctttatcctctgctcctatatcttgaaggaagatggtgaaatcagcattgtctccatttctaaccctctcattaaaagtagggggctatcataggcacaggtgtaactgcagaggaaatcataccagcttccaataccaactgagctctttgtttaaaacaggaacaaatagataaacataaccagacatctgagggaaatcaatagcatgagagagaagaaccaagattaacaaagaaaggtaacataaaaaacaaaagaaaacttttaaaaagttcaatcagtatacttgcaagaatttagcaaactaatatgtctataaaataagaaaatactcaaacggataaatagaaaaaatgaaaagtttttggaaattaagatataattgtcaaaatttaagaaggtaacagaagtcctgtacaaaagaatggacattgctgaaagccaaagaagaaatatggaagataagaaaggaaatctaaaaattaacataaaaaggcagagatagaaattgagtgcacagaaaggatacatgttgcgggaagtcagggaccccgaatggagggaccagctgaagccatggcagaagaacataaattgtgaagatttcatggacatttattagttccccaaattaatacttttataatttctcatgcccatctttactgcaatctctgaacataaattgtgaagatttcatggacacttatcacttccccaatcaatacccttgtgatttcctatgcctgtctttaatctcttaatcccgtcagcttcataaactgaggaggatgtatgtcacctcaggaccctgtgatgattgcattaactgcacaaattgtttgtagagcatgtgtgtttgaacaatatgaaatctgggcacctcgaaaaaagaacaggataacagcaatgttcagggaacaagggagataaccttaaactctggctgcctgtgagccaggcggaacagagtcatatttctcttctttcaaaagcaaataggagaaatatcgctgaattctttttctcagcaaggaacatccctgagaaagagaatgtgtccctaaggggaggcctctgaaatggccactttggggacagctgtcttttacggtcgtacataagggatgaaataagccccagtctcctgtagcactcccaggcttattaggatgaggaaattcccgcctaataaattttggtaagactggttgtctgctttcaaactctgtctcctgataagatgttatcaatgacaatgcgtgcccgaaacttcattagcaattttaatttcgccctggtcctgtggtcctgtgatctcaccctgcctccatttaccttgtgatattttgttaccttgtaaaacatgtgatctctgtgacccataccctaattgtacactccctccccttttgaaaatcactaacaaaaacttgctggttttgcggcttggggggcatcacggaacctgccgacatgtgatgtctcccccagacacccagctttaaaatttctctcttttgtactctttcccttatttctcagactggccaacacttagggaaaatagaaaagaacttacgtgaaatatcgggggtgaatttcccccgatagatatggaaattataaatggaaagaaaaaaaggcattaaagacccatgtgttgcaaaaactatccagaatgagagagtaggggtaacagatgggagaagataatcaaagaaataatagaagaaaatttttctaggaagtgacttgaatattcatttagtcgataagatttactgagctcttactttttgccaggcattgttcttagcatttacagatcaggaaacaaaacaggaaaagaaatctctgcctcccacaaataattaacaaacatatacacttagatatatcccagtgacatttttgaacttcaggaataaagatgatatcctaaaaaagccagtaaggcctggtctggtagggaacatttatctacaaaagcattagacttatctgagactctttgcaagctggcaatagagtaacacctaggactatcttaaggaaagaaggtaattttgacactagaattttattaccagatgaactgtcagtaaagtgtgagggtgaagacaaaccttttattggacacctgaggactcagaaaactcatcactcatatatccttctggtgaaaaaaaaaaaaaaaacaaagcaaaacttaaatatggagtttccaaaactataaagtgaatttaaatatataccacaatatgtgagaaagaatagaaataatctaggcagtaaaacaaatttagtgtgatatctgaaaacaaggttagaaagccatcagttgatattagaacagcatgttggaggctccaagaatgtattcaagaaaaagtagttgtcataacaccaaattcctgattaaaaatcaagactgtaaatgtattgtgaaactgatatattattgtgtgatatattataaaaagtcctataataatatattactgataccgtttcagacagatgagatgaagggttattttctcccaattagccataaaaaggtaatattttcctagtaaaaataaatgcaagaatggcagtgtctgaatataaaactcttttaaatgaggcataattctgggcaactgatatagtgttagaaagatccttcaggggaaacccatcatatctctaagaataaggcagatagcctcaaataaagcataaaagtatttataattgatattagctacaccctgtgaatttcaggtgatcacatggggaggtaaagctgaccaaattcttggaatatgaggttgtaactgggaagtgactggaactagggtgggagattttgtagtagttcacataaagcaggtgaccactgatggaagctgtgagaagaggagatggcagatgaagaggctctggaagtctaccttttaggaggtgacatgaggaagagcaggcacagcgggctgcaaaggaaccctcaaatctataaatatgcactcttccagaaaggaagaggaggtgtccaaaatgagactcactggtgattggtgattggaaaggcgacaagggcatttggcaggaagtgatgacccaattctgttcagtgagggaagaaggcagcttgcagggcaatttggaattggaatgcaaaaatcataagtcaccatggcgtctattcataagaagtcatgaagcgggttggtggggagaaagaagccccctaacctcagccatgatcatcaaaacgggtccttcaactgaggctgggctgggaaagaggagctggcttgctagtgttgtgaaattttcaaagtaagagcatcccatgctggatacttgctgcataaaagcctttgctatatagtttatcttttttaagactgttatagaaactacattttataagtgtccacaggcatatccctgtcatgcttttgcagttataagaagtagaattcctggttgggagttatagtcttcctgtctttgattttcttctgcttgacaaaaaggaataacctgaggttaaagcatcctgctgtgtattctgtaaacaatcccattatcatacaaccacccagtgagcactacttacccttacaaagtatcaacagataactaaactgctcttcagtaaagctatatctgatttcaagtacaaataaaagctctaaatagtcacacagaatgatatagttgatgtaattcaagctctgttctttgtgtttacaatcatagtgctattgtttattttatatgaactgctgaaattcaggaatatgtggtacaacagcgattagagacacgacttggcctacagtagctccaccaatctggaaccctttgaaatgttctcttggaacaaaactcatgtagctgaatgcctctgtgttggaggctaactgaataattagagtttcccccatcaaattctatgtaaaatacagtgcatagtagagaatcagtaacaaaaacatgcaattgacccttgaacaacatggggtgtgagctacgtaggtcgacttatacacagattattttcaataagttacactgagggtgcctgcccatcctgcttccccatctatctacctcttctgcctctgccaccactgaaacagcataaccaacccttcctcttttccctcctcctcagcctactcaacatgaagacaaggatgaagatctttattatgatccacttccacataatgaacagtaaatctattttcttttccttatgactttcttaataacattttattttctctagctttgtttattgtaagaatacagtatttaataaatatataaaatacgtgttgatgaactatttgttatcagtaaggcttccggtcaaccataggctcttagtagttgagttttgggggagtcaaagttatacatggatttttggcggcatgggggtcagcatccctaatcaccacattgctcaagggtaaattgtattgttaaaactcaacagtaactacagcaattgtttagagcttagacccacaaaaggtttttcgaagtggagtattttatcactggcatttttacaatttccagcacctggggataataaaaagcaggtcatttggtgggtttcattattattattaaattctctccagacaatgcacgctgttactgcctgcacccagcatggaacactccctatgttccttcctttgtgcacttctgactgtgtagatcctgaagttccaaagtgtttctcaagaggttgattagctagaaccacttgtgttgattggccagaaatttcctggtgtgactaggaaagccatgaacctctgagaaggattggtacaaaagcctatccaacaggagtacttcatattggatggctgcaacgtgacccaaaccctctcagtgctgaaatatatatgcaggtttatatacacttacatgaggtagtgtctttaagtacaatacgctgtagttggcacatactgaaaagccttacacgtgcctccctggatcagatggaactcagaaggatcaggaactcagtaatggtacaattgatcaggttgcttttatacaactttaaatagcctaaagcaaaattataataataaaaatcgtaatatctttgtatactttcatagtctatgatgcaggactaactctaatacaaaattttatttttacaaaaatgtttgagacacatttctcattgtcttattgtctgtattttacaaatgagtaaactgaggctctgagacattaggtgattttcaaacattattgtccatcaaatggttggaacacaatggagtgggatccaaagcatgaccttctaagtccagtgggctttctgccgtgcagctctgaagtgtggtaataatagggactctcataaatgaaatgataaataggactgcttactggttacatgaagttttcaatctgttattaagtagcagttcagatttcactatgtttaatccaccagcaatgatcttttccatcttgcatacctggcagatgcctattcatcttttaagccctatgtcaagagaagccttcatctgcaaagccttttctgaccccaaaggtagggttagttgttttcttttttctgcagccaatccacatgtgtggatcccaccactcatgtctcacatgccttattaggctaaactgtaactcttaatttgcatgtctgtctctaaactcaactgcgagctcttaagatcaggagctgtcatttattctgatttgtatacctagtgtctagcagagtgtctggcacatcaggctctgagtaaattttacacactatgcatccccatttttggggaaaagaaataacaaagtatttctaattgagggtgagtcagtgtaacatcaccctctcatactgagagaatatatccattaaattctgcttgcttcctcttagagatgaaaaatcagaaatctagagagagagacttgcatcactgcctccacttacaaacactgatattgagaacataataaaattatcctgtggatgaaatcaatattctattccttaatgctgctaactataacttccaaaccaatcttagcaagctcacaaaaaaatatcagagctggaatggttctttggaaaccatgcagctcaataccctgattctataggtgaggaaaacaagctcctgatatgctaagtgacttgcctaagatctcatgtttggtcagtggaagacacaagccactgagcattttccagaacccgttgctgcatctattatccaaaggaggaagacaattgataacaaaaagtccgggggcacaaaatactggtgtgctcacccacacacacactccctgcccaagaaaattcaatggctgaattagaagatctatcaaatgtaaatgacaagttaacaggtgcagcccaccaacatggcacatgtatacatatgtatcaaaactgcacattgtgcacatgtaccctagaacttaaagtataataaaaaaaaaagtgctaaagaaaaaaaaaaaagaaaactcaatggctgaaatatgaccttacacagttaatgactgactacctccaatggagagagttattcaatatgccacagggctcattaaaatgcaagttttattcttaagataacttgaaacaaaattctactctcaaacacaaaggtttacatacaattttgtagcaaaacaattgatgtcataaagtaagacatcaggaggggctttggagtacagtccaattcgagaaatactacctgttaatgcaagtgatctggttctaggtccaactccatcattcatttgttctacaactaaagatcaatctctagccttgttgaatcttccacatttactgattggtgatagaaatacgtgtctttttataagttgtcacaaatgagacaaacacatgttgatatcacgtaccctctgataggatgtaatgcaaatggaactctatctccagggaacctttccccaaaactcacaatcccagattaaccaagaaaagcatcaaacacacagaaattcaggaattttatacaaagtagctcaccagtatttctcaaaactgtcagtcatgaaaaatcaaaagattcagaaactttcacagcccagaggagacgaaagagacatgaaggctaaatgtaatatggtatcctaaattggattatgcaacagaaacaggaccttagtggaaaaactcggatattaaaaaaaaatctggagtttagtttaccagtaatgtatccaggttggtttcttagttttgacaaatgtattgctaatgtaaggcattaaattagggaccttggataaagagtatatggaaactccctgtataacttttctgtaaatctaaagtcatcccaaaataaaaaaattattttgaaagatgacacctggaaaggctttctaaaatgtaataaatgatatccaaatgctagatcatgtctagagagaagatagatttgtgttgagttttcagtggattaatctggcatatagccttttatttttgcctgtagttcatttttttctagaagataagcagaacagtactattgtctatccaagaagtatcacctgttaatcaaatttatacatatttgtagtggaaagagcattggattagaaatgtgcttatttataaacctgcttctacgttgacctgcattggaaatttagatagtaactttatctaatttgctttgttttctcatctggaaaaaggggagtatgagtgcaaattttgtaagggatgaatgaagtaacatgagtaaaccagtactgacaactataaaatcatatgttcatgtgatgggttaattgtgcttccattagctttggagataatgtaagtatgaaaaaaagaataatggtcttcccaaaatgtccatattctaatccaccaaacctgtgaatgtgttaccttatatggcaaaatatattttgcagatatgattatgtcaaggatcttacgatggggagatcatcctagattatccagatgggccaaatgcaatcacaaacattctgaaaagtgggaggcagaagggtcagagttagagaaagatatgtgataacagaagcacaggctggagccatgcaaggaagggaccctgcactgagtaatgcaggtggcttctagaaggtggagaaggcaagggattgatttctcctcagagcctccataatgcaggctgccctagtgacaccttgattttagtgtgtccaacttttaaaatggtaagataataaatctgttgtttctagctactaactttagggtaatttgttataagactgatatggttagcctttgtatccccacccaaatctcatcttaaattgtaattaccaggtgttgagagacctagtgggaggtgattggatcatgggggcagtttccccacatgttgttctcatgatagtgagttctcatgaaatctcatggttttgtaagtgttcactggttcctctcttgctggcttcttctctctccttcctccatgtgaagaaggtgtttgcttcccattcaccttccgccatgattgtgagtttcttgaggcctccccaggcatgtggaactgtgagtcaattaaacctcctctgtttataaattacccagtcttgggtagtatccttatagcagtgtgaaaaaggactagcacatggagctataggaaactaatacaattactttaactatcacttaattgggatgtattgaaggataaacttactggcttatcaaagggagactgaatgtgggtctcttggaaggggtggtcacatactgaatttctgagggagaaaacctcataaattcactatatgccgcaaagcaaagctttcaagaagtggtgtggccacttttttttttttttttttttgagatggagtcatgctttgttgctcaggctggagtgcagtggcacaatcttggctcacagcaaccttcgcctcccaggttcaagtgattcttatgccccagcctcccaagtagctgggattacaggcacccaccaccatccctggctaaggtgtggctacttttaacagcttacagtaagatatggcagcaaaggaattacctaaaggtggaatttgtaattaaaaggaaagcagaatataaaaacatgaaaaatttacagtctagcaatgtgacaggaaaggaaagaatgttttcaggagaaaaatccagtggtgctgaggggtaaccacttgttaaagagattaaaatggataaaagggagtcaggtgcaaagagtcaaaaaaattggaaaaaggtttttcagaaatctttgtagccccctcccatcataggcccacaggcctgggaaaacaaaatggtttcagggaacaggcccgagttaccccgaagccactttgatatgctttctcaacattcaagctgctccagctccaggtgaggcacaaataaccccacatactatttcagctggtgctccagagggtgcaagccataaatctcagcagcatccacttggtgctaagtctgtaggctcctagaatgcaagagcagtggaagctgccaagcctgtagatttcagaggatgtattggaaagcctgggtgcccaggcagaagccttctgcagggaaggagctcctacagggagcctctactagggcagtgcccaggggagctgtgggaacaggagcaccacacttcagacaccagaattatatagccactggcaatgagccacactagcatggaaatgctgcaggtattagattccaaactgtaaaagcagcaatgtgggctgcacccagaaaaactgtgggggcagggctttccaaggacttgggagcccacttctcatatcagtatgcccaggatgcaggacatgggtcaaagaagattattttggagctttaagatttaatgtctgccctgctgggttttagacttccatgaagactgcttacccctttcttttggccaatttttgtctttgtgaacgagaatgtttacctaatgcctatacaaacattgcatattataagtagatgaattgcttttgatttcacaggctcataggtggaaggaacttgccttgagtctcagatgagattttggatttgggacttttgagtagatgctagaacaagttaagactttcgggaccattgggatagaatgattgtattttgcaatgtgagaaggatgtgaggcatggagagtcaagcgtggaatgctacagtttgaatatctgacccttcaaacctcatgttgaaatttgattcgcaatgttgcaggtggggtctaatgagaggtgtttgggtcatagaggcagatcccttatgaatggcttggtaccacctttatagtaatgagcaagttattgctctattggttcctgtaagagcttgttaaaaagaacctggcaatttctctgtatctcttgcttcctctctcaccatgtgatctttgtacatgctgcctccccttccacttgcactatgagtagaaacagcctgaggccctcaccagatgcagatgctggtgccatgcttcttgtacaccagcctgtagaatcatgagccaaatgaatctctttatctcaaaattctttatgaattatccagcctcaggtattcatttacggaaacacaaatggaataagacagcccccaacattcctacctcatagtgtacacaccctctagtatgagtgagatttctgagtataatggaatttcacttccttgagtagactgccatttctggcaaagatgaacagattttgcagatgtgaataacgttcttaatccgttgactttcagttaataaaaaggcatgttatactgaataggcttgacctttaaaagagagtctaggccttctcaggatagggagatttaaagtaagtaaggcactttcctgccaaccttgaagatgcaaactgtgttgtgaactgcttattcagcagtggcaggccataggagacaagggtctcagccctacaactgcatggaattgaattctgccaaggacccacatgagcttgacttcagatgagaatgcagccagaatgacacctttttcagccttatgggactcagtagaggatccatttaagccatgtccagacttctgacccaaggaaactgtgaaataacaaatgtgtgtcattttaaactactaaataaatggtaattcttaagtagcaaccaaaaaatcaaggcaggtaccacttactccatgaattaaggaatgaagagcatgcacagccccaggctggccatcctggatcagcaagtaaccctcaccaaccagccagatttctttcctgggagtactgtgaagaaagaagagcttacactccttacctgttaatcatgagactttttttttttttaaagtggacattttgataaacaattagacatcagtggtaacttgtaggtggttgggtataattaccttccttgtccaataatctttagattttaaaactacccaaaaagaaaaggatggaaaatagcaagctgggagggttattgacctgggtaaaccatttgtacccaattttaaagaatgcaacagatgatgctgtcctgagccaaagtagcctgctaggtccaatgctgatcagaaatggcagcaatgagttcctctattaatcattcagaggaattctgtattatgattttaagctgctgaataagtggtgatctaattcctcagaaattcctgcttcccagatctcagaggaagagtaaagtgcttaaaactatctattgtcctttatttccaggatctccatccaaatactttatgtggcccacaaggccctctatgagctggcccctgaccaccccaatctccaaccattttgcacttgtcactttgcactctggccacagtgacctttgttccatttctcatacatgtcatgcccacgcttgaggctcatgcttctgccttaaacagctggtctaagatgactctgcactagcaacgtccttccttagcttagcttctcctagattacacaaggaggctctccttgatctccagactatttctactaggctttttaaaaccttgagtactttccatttatagcatgtactacagattgtactgatgtgtttgttactattattattttataactcaatttaagggttgaggaacagcctttcactctgtctcccgagtcaagcctttgtctttttctttaaggaatattgctgtctattctgacccaagtttgtttggcaaacattgagcccctggtgcatggaaggcctgaggtatatcctcgaggaataggtggtgggaagagataaggtccctaactctagaagctgaaccatccctaggcccctcactgctcctatcttagctcatatggccctcttctctgactttgaattctgtaagagtttcaatctctcctttgattctttagggtaaaatccaaacttctagttcctttcaggtaaaatccaaactcccagttggtatggccctccataatcaggcccctgctgctctccaaggccttaattcccagagctcttcttgcactagtgaacattctcttccaagcttccaggcttttgcccattgatatggtttggctgtgcccccagccaaatctcatcttgaattgtagttcacataatccccatatgttgtaggagggacctggtgggacataattgaatcatgtggacagttactcccatgcagttctcttgacagtgagtgagttttcatcgcatccagttgttccttcactcagctcttctccttcctgctgccctgtgaaggtgacttgcttcctcttccaacacgattgtaagtttcatgaggcctccccagccatgctgaactatgagtcaattaaacttgatatctttataaattaaccagtctcaggcagttctttatagcagtatgaaaacggactaatagagtaaattggtatcacagagaatggggtgctgctctaaagatacccaaaatgtgaaagtgactttggaactgggtaacaggcagaggttggaatggtttggagggcttagaagaagacagaaagatgtgggaacttcctagagacttgttgaatggctttgatcaaaatactgatagtgatatggacaatgaaatacagcaggctaaggtggtctcagatggtgatacggtttggctgggtccccacccaaatctcaccttgaattgtaataatctccacatgtcaacggcagggccaggtggagataattgaatcatgggtgcagtttccaccatactgttcttgtagtgaatgagtctcatgagatctgatggttttatagacgggagttcctctgcacaagctcttttgcctgctgccatgtaagacatgactttgcttctccttcaccttcagccatgattatgagaccttctcagtcatgtggaactgtgagtcaattaaacctctttcctttataaattacccagtcttgggtatgtccttattagcagcatgagaacagattaacacagatgaagataaaaaaacttgttggaaacgggtataaaggtgactcttgctatgctttagcaaggagactggtggcattttgctccaccccagagatctgtggagctttgaacttaagagaaatgatgtagggtatctggcagaagaaatttctaagcagaaaaccattcaagatgtgacttgggtgctcttaaaagtattcaattttatacattcataaagagatggtttgatattggaacttatgtttaaaagggaagcagagcataaaagtttggaaagtttgcagcctgatgatgtgatagaaaagaaaaacccattttctgaggagaaattcaagctggctgcagagatttgcataaggagccaaattttaatagccaagacaatggggaaaatgtctccagggcatgtcaaaggtctttacagcagccctcccatcacatgcccagaggcctggaagagaaagtagtttcctgggctgggcccaaggcctagctgctttgtgcagtctctgggcttggtgccctgcattccagctgtggccaaaaagggccaacatatagctcatgctgttgcttcaaagggtgcaagccccaggccttggtggcttacatgtggtgttgggcctgtgggtgcacagaagccaagaactgaagtttaggaacctctgcccagattttggatgacgtagggaaacacctgaatgtccaggcagaagtttgctgcagtggggagccctcatggagaaactctgctagggcagtgtggaagggaaatgcggggtgcgaactcctacagagtccccactggggcactgcctagtggagctgtgagaaaaggaccaagatcctcctgaccccagaatggtagatccaccaatagcttgcaacatgcacctggcaaagctgtggacactcaatgccagcctgtgaaagcagctgggaggtggactgtaccttgcaaagccacaggggcagagctacccacctcttgcatcagcatgacctggatgtgatacacagagtcaaaggagatcattatggacctttaagatttcactgccttgctggattttggacttgcatggggcttgtagcccatttgttttggccagtttctcccatttggaatggctctatttacccaatgcctgtacctgcattgtatccaggaagtaactaagttgcttttgattttacaggctcataggcagaaggggctggccttgtcttagatgagactttggactgtggacttttgagttaatgctgaaatgagttaagactttgcaggacagttgggtaggcaggattggttttgaaatgtcagagacatgaggattgggagggacccaaagtggtacggtaggtttaggctttgtgtccccacctaaatctcattttgaattataatccccataatatccacatttcaaaggagagaccaggtgaagtaattggatcttggggtggtttctcccatgctgttctcatgatagtaagttcttacaaggtctgatggttttgtaaggggctcttcccccttcactcagcacttttccttcctgcagccttgtaaagaaggtatcttgctttccctttgccttctgccataattgtaagtttcctgaggcctcccggccatacttaactgtgagtcaattaaacctctttcctttataagttacccggtctcaggcagttctttaaagcagtatgaaaatggactaatacaatccctctttgcctgtgctgtcaagtattcctcacattaccacccttctccactttgagtactcctgaaccttgtcaagacccagttctaacttcctttcttcctttagccttgtagtgagatgcctggccctggaagactgctttaggctgcaagtgacagaaagtctgactcaaagtggctcaagcagtaagaagtttgttacgtcacttaacacaataagtggtgaggcagttccatggtgaattcaacccttaagtgagccatagaagatatgggtttttctcaactctccattttgccatcttagtgtgtcttttgtacccaagtttattcagaaggcttctccttacatggcatgaatagaactgtttatcacatatgcatgactatattaatgtattactctgggttctcctgagaaagagaatcaacagaatggggtgacagtgagagatttatttaagaaattggctcacatgatggctggcaaggatgatgtctacagcgtaagccgataggcaggaggcctagggaaatgttgatattgctgctcctggcctaaggcttctggaggcagaactccctttttctttggggacattggtctttttctcttaaggccttcaactcattggataaggcccacacatattatacagataatctgctttactcaaagtttactgatgcaaatgttaatctggtcttaaaaagtacctgcccaacaacatccaggcatgtttggtctaatatctgggtacgtacctagccaaatggacacatcaaattagccatcacaatgtctaaaccaattactgagaagaaagagaccagaatcaccattgttggtataaatctcagccaagagtaaccctctggggctggtaaggggctccttccctgagtatatgatggtatggagggcgaatgtgcaagcatagtcagggctctgcctgcaagacagactctagttgtgggtaaggtcagaggaaggcataggtttgagcaggtaaacaacatctgttaaacacttaggcaggcagaatcccaatactgtgttgcctcctttacatgtataaaccctgttggagcccttgttaccctgagtcatggatttatggcttatcttcctctttagactgtaggctcacctttgagtaagaatcatgtgtgagttacctgtttattaaccgcccaaacttggtgctcagcacaaggtaggtactccataaatgctattgaactgaccaaagtggggcatttgcgtgctgaattaaccttgtactcaccattgttatagagctcatatatttttatccaccacagctttgttgaagtcacagattcacaactgttatgccaactgactattatttctagacacttcagtgaggaacttatgggacgataaaactagttcagtcatatcaagttctctcctatttcacacatccataacctgaaaaaaatctcagtaacaaattgaagaacactcttaactttatagtcaagtaataagaggtaaggggtccattgtttgccacaagtacccactcagataaagtaggtcatctggagtcagatgttagagccccaggttcagttgcttaatccacaaattctcatgactcttatccttttcaacagagttggagttcccaaaagtttagaaagtggaatcatcagataccaatcttctctaccagaaagacaaaaggctttagacctgttaaattcagaggatgaggaagtcatcttttagttgtccactgtgtagaaacccttgaccttataaattcaagcatcccccatgtttcaggcatcttgagaaacccttacacacattattacactatccagtttgtaattgtctccctcaagcagataccaacaacaattgacatatactgactcaacatgcaccagacatgaacatacacacattacctccattatgcaatttaatcctcagcaaacctcacaaggctgatttagtccttatctccattttacagatgaagaacccagggagctgagctgggtaggtaacttgctgacagtcctaccaacaagaaaccacagaacccagactcaagtcccatcaactctgacttcagaggccatgatcacacttgcacacgttactgcttcccatgtagtaaggtttacatatattatctcaattaaatttgagagtgaggaaaagttattttatatcaacatgtaaggggacaataaaaattatttcctgtggttgtcttagaagcaacaaccaactcaaaatagggccttgaacactttaaagaaagaatgtgacaacagagaaaaaaacatcgaaaaatgtgaggcagacacacaacattttgcagtgaccacccagttctacccatgggcatgtcaatcactacagaggatgttctctttacaggttgtactaacttagcaagacttcttattacctggagagaataccctttatttctctaattccatactcaaaaggtacaagaatataattataaatgtaacttctgagatatcttgaatataacagatttcctaggaaaaaagtatgtaaacattctatttctttaaaagggacatcctcaattgtaagtattgaatgccatttgtcaatattgtttcacatgaacatagcttgtgccaatgaaattgttatatcattagaaacctggtcatttctagatgaattaatcaagttcggtttctatgttcactgggccatagaatagatgtgccatagtaaatttatgaagttaataatattcatttctgaggctatttggcagccagttggctttttcctgggtcacccactctcccttaccatgcctgctttcctccaactgcaaagcctcacgagtacttataattgccccatcatacaaatgagaaaaaatgatgctcagaggggttttgtgacttgcttagctctgcacagctggtgtaatagactctacagaaggacaggaaaagaagacatagaagccaagaatgaatgaggtgacctgggactctgctctttctatttgccaccaactacagagacctcaactgacatctccagccctctgctttcagtgccggagtagagattgcacactggctcctgctgagagctttatttcttattctcacatctgagcagttaaaaatactttgaaatatgtcacctgccttcccttctatccttgccttttgcttgctttttctcttgcctcgctttactaaagcagcaaaagcaagaggaccattaaaagcaagaggaccataatgagggtaagagtagtgggaggagacacagggaccctccaccttgcttctgaacgaaagtcataatataatccttgctttaatctgtattcagttctctgtcctctgcccgcatgctgacaagatccactttacctggtatttttagctgatacttggcgcgatgtgctaagtgctggccatggatgctgctaaagtgacagcatgtgttccagcagctccattgccatggtcagtcttttcatagttcctgtttcattaatgttaagaaatggctcttccttacttaaccaaatgtcagcagacacagcttcggcccttaatcatccatccccctgcccctgagggcatcctatagattgaaggacattgagactgcaggctcagatggaaaaaaaagtaatctaattgcctgttacttaacaaactttgtcttgatggagtattcattgcacacataaattagactgcctcaccttttgcaatgtaaaatcctggaaataatgctagccttcattctaattgtttttaataaataaattaaagaattaatgtgtacttacctggaacaaagcttccctggaccacctccttgtatgcccaccagccttcatggatttttggtgaattctgttgagctaaaggaaaagcaaagaagagagattaagatgatagcagagaagcactgtgtcccggctgtccgagtaagaagggtgaatatccataaaataacccttttctaccccaaagtcatactacaacagaaccttccttctcccttcccttttttttttcaaatagatcattgatcggtaaatataaaaacatttttattgaaagttctctgatattttaattgatgttaaagagatagtaattatgtatttaagtcccctgctacctgtcctcatcatcttccccatacacacacacacacacacacacacacacacacacacacaacacacacacagtgctcctgctgaaactgaggagacagtaggcagatcccatccatgtatgtccatggaacccttgttttgggagagattgaagtttgctgagggagccagtctggaaggctgaaaggtatacccagccagctttccttaggtcccaggaaaatgaaaacaagaatataaataactgtggtggaggtttttgacatcacaggcaaaaagggcagagggctcaagatattggaaaatatcgtggagatctgtaagctcatgctgacatgacctcagggaaacccttgaattcatgacagttgacaagtgaattggggcaatgccattacacatgcacacaaaccccaaagtatacatgatacataaatttatgcttatccctttattaaactacattcatatttcaattcccagacacattggaagaaaataagtgaatcaatcatatttgtaatttggctactattaatgttaaatcttaacttttttcttttcttctttaaatctggtgggggtttttttccagccttcctcttcaaagttctagggaaaagactcatcattctgagttagaaagaatgggtataagacaatgggtttgaatgcaaggctttgtatagagagaagatttactagatttctctagtttccagataagcttggactgtttagcttcaagtctcttcttatagtatagtgaagatactttttcttcctatgatattaagagccctgaggcttgtatctttgtggttgaaggagattttctgacataggatgagtgaaactgaagcccactccttctggaactgacagtgggcttaggggactttaaaaacaaataaaagagagacaaagagcttatttaagactctggaaaaaataacacctttaaatttgcccagcacaaatctcaggcatggacacacaaaagtatcctggatttcctggtattcttattgcccctgtggtgtggatagagttcagacatttccatagcccttgaggaagatcccgaggtcagctgagttggaagccaatgcatctgctctgggacagcaggcaaaggaggaagtcacctcaaagcagaagccagaaaggttctgtccaaccagggagtcaggcggaagattcaactgagactctgggaatttgcagcaccagggaaagacaaggagatttgaagtcagccaggaggtctttagacccgaccaagccaagaaaccaaatcaaggtttggatatggctgcaaaattccccaagtgggtagacaacatttctctagagttcagaaagggttctgattcttcctctgggtcttggtattgcctgactcaccctccttctcccccaattcgttagacagtcatcataggagccagaggagaatcccaaaggcttagaaacctgtgagatcagatatctaatggccctcttatgaaacaactactttgtaatgctcaccttgagtataattaaataaaattcacggacagtacaacctactaaaaaacaacaacaagaaaaccaaaccccaaacctgataattctctaaacttcagcctagctctgctagacatgtaaaatgtctcaagcctgggaaaaatgcatgtttctaagatcttaaaagcattgaactataaacatcacctaacagttttgcatcagagataagccaggactggttttccttacaacaggcaaaaacttcagagttttataaaaactcacaccaagttttatccagtcaggattactgactgtcatcaaacaatttaaaccataaatccagccttctctctttattctacgagacagtcattggggaagctgcattatcttgcatgtgtttcattaccccaaataaatatacacttagcactcaaattttgttacattaagctttttacctaattattttacaaaaaaatttttacagtgtttacacatcactttaaaaatttaatgtagtgctttaactataaataaaagaaatgtaatttataataatatatatttcaatgtgaaaatgcttgagtatgatacactagaacagagattggaaaacttgtgcctgctagccaaatatggcccattgcctgtttctgtactgcacaagagctaaaaatgaatttacatttttaaatggttgaaaaaaaagggttgaaaaaaatgttttgacatgttaaaattatattacattcaaatttcagtgtccataatgttttattgccaaatagccaaacatatttatttacatagtctctagagttgctttctcactacaatggcagagtggaatagttatgacagagaccatttggcccacaaagcctaaaatgtttcctccatggctctttactgaaaaaatttgttgagtgctaatttacatacataatttcaaaaggaaaaacaatcaatataatcaatatagtgctttaactataatacaagggggaaatacaaggaacataatgtaaaacaaaatattatatatttcaatatgtaaatacctgggcatggtgcactagaagaagataaaatgaagaagttggatgcttaattaacacagacacaaataacaacttcatattatattagagattccagaatccacaagtggcatttctctcaatggtatgtggttttccaaaatagtgaactcttgggaaagattagaacacaattaagtaccaccttctcttgatttacatgatctttgcattgctaaagaaccaggtataataaaactttgtaagacatgctttgtgtgtatatgcaaaatggagtttgattggagggtcaaataaataaaacagtttttccaatcacttgaatgtctgttgggacatgggataatttatcgttgtttctaactatctaatatgttgcagagcatagcatctctgtccccctttagttgttgctaattgccactctttcattataacaatcttaagtgccctcacccatttccaaaatattcccccagaaacggtgacatccctattgacagtcactgacctaaaggtgctatttatagtacttacatgtgctaaaagaggataaaatgaaacattatgttgaacactagaggatagcgctttgtctaagtagacaaaagatacatctttccccatctatctgaattgtagtgtcatatggaatacatttgccaccccattaccccattatatgttcaaatattttttctactctttcctgccatttgaccatatcattaagaaactttcatttctacaagggataaagcagtaaggaaaaaagagaaagcatacatgcatgttgtcaagacggcaaaaaagggaaagctaactctaataaaacctgagtaagatgactaggttctcagatttttagatgcattcctagtccctctttttatctctcttcttacatgtgcatatcttccacactcccctctaaggacaacctatcagtcgaactgaaatatcaatttaagaaacatctatctagaaggaagaagaaagaagcccctgggtaagtaagagtattggcactgacaagattatcaccaaaagcttctgttccatccagaaagttgcaaaacactttgctctttcttcatctccaatcattgcttctttggctatcacatccattcagaagcagaactatgtaagattttagcaggtaataagacaatcagaccatctgaataaagcctattgtaatagtagaactgcagagctcctgttagctgtctttgatgtgcattgtgaagaaccaaattcaccctccaaaaatcaatcagctggaagagcccatttgatgtctatcaattacaaaatttaatggctgcagactagaagaaaataaagatgatttatgtaatgttttcaaattcccttggatgctcaggctggcctcatactgtttggtaatttagaaagacaggatggcacatttaaaaaggtacctcacttaaagttctgccacagtactacaagaagtttattatagatggatctcctagagaaatacaggattcttattttaacgcctcccaccagatccttggtagtcatcttgttgttgtttacatgtgatttgaagtgagtgaagagctgattgagaattcctcagagcaaacaggtgaacagagagccgcctgagcttttacagcattctatgctcctctttgcctaggtatggatcagaattttttaatgtgcaaccagcccctgggaaaaatccaggtgtctaattaaaaaaattgtgttgacaataaaaattgtcatcactgccagaggaaaagatatacatagcaaggaaaaatctatttcagttttattcttggtttatttttcactgtggcagtttgagaactgatgattttccaaaggaaactctgaatctcagaattttgagagacaatgttcattgctccaatggcttcttatacaagtgagcagaattatcttacataattctacttctgaatgaatgggatagctgaagaagtcatcgttggggatgaagaaagagcaaagtgttttgcaactttctggatggaacagaggcttttggtgatcccttcttgcacagagaagggaacctcacttgtaagaggttggggtcttaaaacagaggtcagcaaattttttccataaagggcgacataatacatgttttaggctttgaagcccatactatttctgtgccaactgctccactttgccattgtagcacaaaaacagctgtatacaatatgcaggggtgtagctgtgtgccagtacaattttatttatgaaaacaaagagctggatttgatctgtaggccatagtttgctcagttctgtcttggatctaaaagatttttgttatccagttctgtttcttacttaaatgttcagaagtgagctactttacaaaaaaaaaaaaaaaatcagaatgttgaaatatatgggtttctaattacatgtgcctgatatctgatcagtatgtactgcagaaggtatctatcatactaaatcttttccagatctgaaattggtcaccagcatctacataaaattgaatatttccctctctccacccgatttccattgggctaaaccaccaaagctggtggagctttatataaacaaggcctacaacccatgctgggtttttcaaaccagtcaataaagacctgaacaatatcttgatccccttttgttcttcccacaagtccataaactctctcaagcaagtatgggcctgccaaccaacttaaaaaattatgttcatatacccactgaccacaaatacaggcatcacaccaacaagtctttggatccagactaaaacttcccaaagatgatgtgatctggcctgtgagtagatccctatcattaacagagcttactgctccaagtcaactaatttaactaacttaggttcagagaaaacataactgcgaaatacctccatttggaaattacagtggtctcttgacctggtgggaaacaagacttaaaagcaacatctgagatagcacagttgaggtagggaaggaaatggtgcaatagggaacagaagagccctcacaaagggatccagttggggaagggatgttgcttaataaaactccaccatcagtcaaaacataccaaaccataagcacatacattgcaaaaataagcttccaagccctgggtcagtacaattatacctgtgccaagtggtctacaactagcaaagatgaagccagatatagaggagaggcagagtacatacactgctatggttacttcattttaatgtaatggtagaagccctgaatggttgtttccctcagaaattgcatttctccactggaggaggtaattcaaggaggaaggtaccaagtctactgaccaggaaacaacataagttggaaggtaaaaaagtacttctaacattggatgcatatccatgacatcacttctttccttgcatggccaattttgtgttctaagtgggaagcaggaacattgagaagtgcatggatcgtcagaagaaacataaatgactgccccattgagctgcatggcactcactagactaacggggataatgcccttcctcaggtggttgacttttacaacacccggaaggtatttttcttctgtgcactctctgtattatgtgtggtcctacattctaacatttagatagtgccccacactatctgtttccatatcattcatttccacctaaccgtaaccttcctgaggtcagagaatatatcttattttaaaattccattatttggccgggtgtggtggcttactcctgtaatcccagcactctgggaggccggggcacgcggatcacgaggtcaggagatcgagaccatcctggctcacacggggaaaccccgtctctactaaaaatataaaaaattagccgggcgctgtggcgggcacctgtagtcccagctactcgggaggccaagacaggagaatggcgtgaaccggggaggcggagcttgcagtgagccgagattgcaccactgcactccagcctgggcgacagagcgaaactccgtctcaaaaaacaaaaacacaaacaaaaattagcagggtgtggtagtacattcctgtaatcccagctacttgggaggctgaggcaggagaatcgcttcaacccgggagacggaggttgtagtgagcagagatcacaccactgcaccccagcctgggggacagagcgagactccgtcaaaaaaaaaaaaaaaattccattatttatgcaaaagcttagtacataataagtgccagaaaaatattgggtgaatgcctgataaacgtggtagtgaagttgtatattataccaacttgcagtccagctcacacaatccttgggaggttttagtctctatccaaagacttgtgggtgtgacgcctatatttgtggtcagtgggaatgtggacaaaagtggtttcaagttggttgacaagcccacacgtgcttgacagatggaagagtaccaggagctgacaccctgcctagggaaatcaaagccttagcaaacccacttttatttagcacaatgtgtttcatttaaaagcaaaggggaagatgtgtcatacctggaactatttacatctctgtctttctttgcttttcctgaattcgcaagacaggatgaaactcatttctatctctccatcctatgtgaaaaccccacttgccatacaaactagacaggacactcagaacattgagaattgaactggttaatgggtgacaaagtgactatttccaaagagagaagatgggtatgacctagaatcaccttgcgtgttggaccagacctaagcaagctgacaaaattatatttgtgttgggagataagaaaaaaatattgatggcgggtagcccgtattactttcatctaaaatgcttagcatgatactatttttaagaagttcaaggccaggcgcagtggctcacgccactaatcccagcactttgggaggccaaggtgggcgcatcacgaggtcaggggatagagaccatcctggttaacacggcaaaaccccgtctctaccaaaaatacaaaaaattagctgggcttggtggccggcgcctgtagtcccagctactcgggaggctgaggcaggagaatggcatgaaccagggaggcggagcttgcagtgagccgagattgcaccactgcactccagcctgggtgacagagcgagactccatctcaaaaataaataaataaataaataaataaataaataaataaataaataaatattaaaataaatagagagaagctcaaaggtaactagacttgaaaatcatcaggaggaaagtccctattatggctaattctcagcctagtattctagaatttctgcaatttgggtttaccacacatttaatatcatttctcataaaatttacaagagtcattcttcctgctgtccccaggtataccacgtttattactctctccacaccttcactctgccctttttccccccgaaattccttctttgtctactttttcttgacctggtcttactcaattctcaaagcctctccaatttacactcctttcaagaaaggtgtactgatcattccaactctactgtaatccctaacttccctgaatttcagaactttagtgtctattcctcatttgccattcctgttaattcaagaaacatctagtgagtacctatgattgtcagtaagtattctaagcattgagggtacaaagttcctgttttccatgaagttattaggtgggcgcaaaagtaattgtgggttttgctgttaagtaatggcaaaaccattaacagcaaaacccacaatcacttttgtgtaaacctaatacattctccgggagggagacagagaaaaggaaagaactgaattcaaatatataagaaaaattggagaaaagtactctgtgatatagagggtgaggtagtaaagtgactagaagaacatatgagattgtatgacagtgatggtctctgaaattatgacacttaatcagagatttaaataaaaataattggcttcatgaagatcagcagtggtagtatttcaggtggattcaaagactgaaagttggcagaaataagtttggcttctttaagaaaactaaaagtggccaataggtgtgataatagtagatacaggggagaggcaggctaaaaatgaggccggacaatgtaagtagcggcccaagagaaaggtggtggtggcttcaactagggcagtgctggtgaaaatagaacatcataagatttagatgaagcggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgttaacctgggaggcggagcttgcagtgagccgagatcccgccactgcactccagcctgggcgacagagcgagactccgtctcaaaaaaaaaaaaaaaaaaaaagatttagatgaagcatggataagacttggtaatgaactggatgagagaagttgaagacttctctcaaggaaaactcccaccctttttagtctgagtgactagatgttgacagttactgagatgaccagggagactaagggagtaatttgggagcatcttcagtctcctcatggctgcaacactttctttgtatatttttaacatatattttgctattacttctctctccctgactaaattaaagctgtctcaagggtaaaaatgttgtgctttgtcttccataatgcaacacatatcgtaggtacactggcacagtgtttgacaaatatttgcttaataaatctaggaaagggagaatgacatgtgaacctccatttataaatgttatttacaagttttatagaaatattcactctgatgactaccctctatgatttccttggaataagtttaatgataaaaggtccttagaattcaaagaagagtgtaactcaataatagtggaacacaaaagaaaagggacaaaaagattacctctaatctctgtaattttaagagggtaactataattttgcttctttcaccaaacattacgtcttgttttttcattcttatttttaatgtacagatactagttattttagtagctatgccataatttaccaattattccttccctattggttatctagttgtttgaatactgcacttaaccttctcaggtacaaagcttccctcactcatcctcttttagacctttctttagcacagtgagccaaaatcacagtcaagggacagaagtatatatgttgagttactttgtaaaaaatgttataacaatctgcattgccacaaaagtataaattattatttctcaaaggaaaattctggtggtactttcaggataactacataataaaataatgctaaccatttaaatataattttgacttctgacaaataggcaacttaagaagcatcattagtctaatgaatgaatctgttctgtcatcagctcatgagatggacatttcatagaaatctattccatatttttactattatttatctgtttggaatcaggtatagatttattctctgtaaatattgtagctcctttttgtagtagagtgtatttatgtttttaaacagatggatgaaacttcagatcccaagagtacaagtccatgcctaggttcatgcagcctcccataaatcatagcaataaggaaaatgtgtatgtgctatattcagaatgctaggagcatactaataactccatttttaaactacaattggaaataaactactggtaattcctaaaatcaatgggtcagtcaattgtggggttaatctcatgtcacataaaactttctattacagctgaaatctctgaatgagactaaaatctccttgtatctctcttaagcttgaattcagcaaggctaaatgcaacgaaaagaaagaaatccagcagaattgttggtttgggaggcagtgtgaaatgatggaaaatacatggcaccctggggttaaatcacaaatttgctactaattgtgtcactttgggcgaattatttcatctctttttaaaaaatgtttatttgtataaatttaaaaagtacaaatgcagttttttaaatacagatatattgcttagtggtgaagtctaggcttttagtgtaaccctcaccttaatgggtatattatactccttaaggaatttcccatccctcatccccctcactctcccacccttccaagtctccaatgtctattattccactatgtccatgtgtatacatttatagcttatagctctcacttataagtatttgtgatatttgactttctgtttctgagttatttcacttaagctaatggtcttcagttccatccatgttgctgcaaaagatgtgatttcattcttttttatggctgagtagtattccacggtatggatataccccattttctttacgcacttacccattgatagagacttatgttgattccatatctttgctattgtgaacagtactgctataaacatatgaattcagttatctttctgatgtaattatttcttttttagagtagatacccaatactgtgactgcagattgaatggtagtctatttttagttaccaagaaaactcctctaaattgtgagccaacttgtggaagaaaaaagatagccctccctgactgaaaaaagacttaaagagcctctgaggacattcgtgccatttgtgagtcaaagtacagtcactgaagaaacttggggaacagaatataagacttgcagcaggaaaaaaactgattcagggaactcatgcaggaaacatgtggtcttcgctgggacaaagcccagagaaagcccaatgcccggtagaaaagtaggcaaaatgacctattaagtcaatttgccatggtgggacataaagccacatgcaaaccataggaaaaggccagggcagatttattttttatgtatatcatagctcaacatagttttgtccttcattctgattctgatccacacagcatttgctgagcatgcactatatgacaggtgctgtcacatacttataagtggtagagccagtgaattatgaccatatctgggctttccacaagccaaactggagtttcattatataaataaccaagaccaaactaaaatttggaacttgaattgtctggagagttgtatctgaggagatttgaggaccatccctatctcagctactacttcaatgaggatgattctcaaatttatattccccacctggattttttattccagttccatgcaagcttttcagcagcctactaattagaatactgctattttccaggacctcatgatcacaactgtcttctgcccctgtggcaaaaatagtgctactaaatctcccaatatttatttccccttcttccttaacaaggaaaactctggttttagtaagacatcacagaatacagactatattagccatatctcctttgtaggtaggtgtggacatgtgaataagttctggttaatgagatgttagaaaatgtataagagttccaggaagtgctaaaagaaaatgctatgcctctcctcacctcttccagcaagccgggatgtggacatcatagctagacttcaaatagccatcctgaaccatcatgcaaatgccttattttcagcatcaagatagaaagagctgggatccctgcatggcctacatttataagatataaataaatctccatcttatttagacttatccatcactcatagctgaaactaatcctagctgatacacacttgccttcaatacccatggagtgaagacattgactctacttctgctatagctctaatccattctttccttcacatttctactgcctagacacagatcctagacaaaggccctcagtgattacttaaatggccaattatagtggcctaataactggactcctatgtccatccatgctccctgctgtggtcttcacacctcctgcatgattatgtttcctgtttacagcagcactgtgtccatgtcgtctttcacttttgaggggtagtgaaagacatgcacagagtcttcctatgaagctcatttaccagctatttacacagccaggtccaaactcattgaccatctttcaagtctctctgcaaagcccttcaatgactccctattggttacacgataatgtgcaagtgttccaatgaaactttcaacaaactgtatggtgtggttaacttatctgttttccaaaactcatcctatctcctttgggcatcttttctctgtgctctcatggcatttattatatacatttacttataacatatatatttttcttaaataacctcttcatgagattgtcctcctgtcagaataggtgccctgtaaatgtatttggactgaagtaaatttagacatttgtttctcactgaccaaccctagtcagactgaactatctgctcttggtgatgtttgccatgtgttcacactatttacttttactggaatatcatattctttactgtatatccaaagtaaaccaatatttcaagtgtttgctcaaacactaccttctaaaaaccttccgtggtttctccagataaaagaaagctctattataatctctgaagtttcttaccatattgtatacaatttatttcatttcagtccaattcgatatgattcaattcaatcaaatccagaaaatattaatatttagaacatactcattatgtttgcatactcattctaggtctttattttggagtggtttacagtgcaatgagaaataaggggatgtctttaatatattctaggctaaagtgtatgcaatatacaaattaagataatgatagtgttgacaatgctagtttacctgcgagaacaggcaaactctaaaatctcaatggcatagtacaagtttatttctcatacatataaatttccaaactggttttcctgattggcatatagctctccaagtcagggcccaggtttcttctgtcctgtggctctgctatctgcaatacaagacttcaaaggccgctatgctgtgtaggtcaagccagaatggaaaaaagcgtggaggatttttcaaaagttgttttcctggcttaaacctagaaataatattcactacttctgcccacatttcattgactagaacttggcctctttaatacaactaaatgtaaaaggaggctagggaaatgtagtccagctgtggactacacagtggtgttggattggatagaactgagggaagtcttgtagaatccctcacacacaatgacactgaagagaatttgaaagttttccactcccttaaaatggaccaagaagaggagtaaatattttttggagaacatgcagccagagtggttataacttctaatttgtctagaatattctatttgcatttgttgtcccaatattgttataaaatggggtctcaaagatgtcccagtttagatgataaattatgtgatcatctctacacttagcagtcttttccacatgcagctttagccattttgaagactctgttgtagggcatttaggtttctaccagattatccacatattgacccatattttgtcttgtgtgtttgttgcctaaatgaaatcaagaatgtgcaccttctctcaatcctcctacaacctatctctttcccctgctttcttactcaccatttgccagccaataagtcaatacaaacaactcaattggctacagaagacacaattactagaaacctgatgacccagataccttttcttgtaattaattaattaattaatttttgagacaaagtcttgctttgttgcccaggctggagggcagtggcctgatgtcgtctcactgcaacctccgcctcctggattcaagtgattctcttgcctcagcctcctgagtagctgggattataggcgtgtgccaccacacccggctaatttttcatatttttagtagagacagagttttgccatgttggccagactggtctcaaactcctcacctgaggtgatcctcctgccttggcctcccaaagtgctggggttacagatgtgagccaccgcacctggcccctttccttgtatttaaatgctagacaaaaagaggcaaatgtcaagaaagtaagattagagaaattaaaggttcagtggtagaaggtatggagaatggttccttcttccctgaataacttttcttcaacagcaaatattcaacatgactccctatgctgtcttcaattctgttctatacagtgagaatagctgccggaatgagttgtattacaacatattgaatataataagttgtaattatcttatacagaaattatttaattacatttaattttctcctaaatatgaaacagcatgttcagaaaaatgaaaatacaacatagaattatacatgtgaaagggagatttaagacagtgttttatgccccccttatttatcagatggggaaacagagtcctagaggaataaaaactttcagaagagttaacggtagaagccaacactatgaggtctctggtgaccaaattgctgctctatcaactacatacaaaaggattttaaaaggagctgaaggccattatccttagtcataggaccagaacaccaaataccacatgttttcacaagtgggagctaaatgatgagagcacatggacacatagcagggaacaacatgcactggggcctattggaggatggagggtggggaaaagggagaggatcaggaaaaacaacaaatgggttctaggcttaccacctgggtgatgaaataatctgtaaaacaagccctcttgacacaagtttacctatgtaacaaacctgcacatgtacccttgaacttaaaaaaagtttaaaaaaaaagtcataaaaggaagaattagttgtcagctaaacagaacatctgaattcagttatttaggataattagttcagtagtcagcaaactccaaagtttttaaatatcacatgcagtcattctacctaagaaatgtgtaacaatgagattctgtcttgttggcttatagaaaagtgactctagaggagtatgtgcaccctgtataggaaaattgagtggaagaacagtttggcaagctcctgggtcacaagttacagtaagcaccttttgttcttccattattcacctccagcactctaccacataacctcaagatctactcactttgtacatcaaagacagattattacaaatgaaaagaatgaaccaataggaactgctttccttgagatccccctctaaaagttaatctttcaaggaacaaaggaaaatgcacttcaaaataggcattttccccctcaaacaataggttttctcaaatttctgagaatgccaagaacactgtgtttttgttataaatgttacatgccagcatatgattacaaaagcaagaaatgaaaagaaaaaaacccttacactttttaaaatcacaggtgaggcagatgccatttgtaagagctacaacatccttaactttcagaaaagaaaaaattaccaagcacaaaagtgaaaaatacactatagattatatacaaatctgtcaataaaatgctttcatcatggtggccaggtttcacagattatgctttgtttagaaagtaagcaattccatcattaggctaatgctccacagtgctacaattctacttcctttggaacaggcaggatcatgtaatcacgaatttcaaaagatgggcaaaaccagacacagaaaacgttccacatgctactgatgcaaatgttgtactctaattttcaaggtcaaaaagataggataggaagattacagaagtgtgcaagaaatacaccaatattgaccttaactgagtttttgtgtcactatgtgtacacttactatggtgttcaatgaaaagatgctggtcttggtgagtgtacaatgtgtgaaagtgtcaccacagggaccaagggtgggctggcattaggtcttggacttgagttggattccaaggttttcttagcagccaaaagttagccaagagaagaaataaaaatagctaacatttaaatagcttttataggaaggcactgttctaagcattttatatatgtattgactcattaaattcacatcaactctcttttgtgttacagtattcctgccttctctgcaggggattatgttccaagaacctcagtggatgcctgaagtctcagatagctggtgactatttatactgttttttttttccctctatacgtagacacttatgataaagtttaatttacaaattaggcattgtaagacattaacaacaatagctagtaaacaatagaacagtgataatatgaaatgtatatatattttatatgacatttataatatacatattttaaaactctcaaaactataaattttatgcatgcatgcatatgtggtaaagttataaaaccatggatacatattaacttggagaaattggttctctatcttgagaagaagggagagatggggaatacaatttggaaaggatacacagattactaaaattttatttatttgaaaatatcagaaacaaatatggcaaaatgttaatatttgctattttagaatgatgagttattagtatttcacgtattctcagtagtttttccagtatgcttaaaagaagccatgattttaaaataggcaaggaaaaataggtatagttgtaaacaaacaagttattaagtaactgtaaacgtgtttttaaaaattagctagaaaaaagcaacctcagaagggaagagtaagatagataaatcagtaagatagagatcagtgagaatcttcatagttcaaaagtgataggccaagtaggcgtcaattcttaaatagatgtagttttaatgaaatcctaattcagtaacattaagggattcttcagtaacttaaaactgtttccaaaattacatggaagaacaaacaagattttttaaaaagacttacttgcagagatatcaaaactttataaagttataataactaatatgatgaggtattgataagtaattgacagatcaattaaacagcattgatgatgctgaaatattccctagcatatttttgtataagatataacggtgtaaatatcaaaatctacagcaaagaagtggactatttaacaattactaagaaaattggctaattgtaacaaaaattattatatttgtcataatatacatcctggatagatttaaaagttaaatgtaaaatgaaaattttaaaataggtaaatagaatataactatttttttctgtaaatacagcatctttaagttaatgtaggttcctctttgtcctaaacctaagggttttttatgcattctaggtagaccagcagtctaactctcacagaacattcagagaaattaaaataaattctgcccacacccctacatgagatgaactggaacgtggtgtaaaactgggttacagatctatgtagattatctgatgatctgggcttctttaaaggaaagataagtggataccccagggaagttaccatgaaccaaggaagacaaagatttatgtaaatagctgctgactacacactctttttagtaaacttacaaataacaggattttgaacaatacagcattagctaaatatattatggaacactcacactaagaaatattaaataatgttttttgaagattatgtaaagacagaaaaatcctcaccaaaaaatactatctgaaaaaaatcagcatataaaaaagtatataaaatatgatcctaattttgagaaggaaaaaatatctggaaggaaatacaaccaaatgttaagtgaggttattttcaagtgttatgatgatgaagtgaagttaattttctaaccactattttccaactttttgtaatgtgtattttttatgattaggataaaaatggtataaaaatttttaaaaaggcaaaacctcccactgtgtgctgagcttccccgaaccagtgaactagatttcactgaggaccctaacaacttctcagtggtaaaaataatgagttttcccaacattaagatttaattttcagtggtatagatgggagcaagaaagcccaaaggacattgaccgtttctgagcctaatttctcactcccgcacattggccactgtgctgctggctaaacaatttccccccattctcagttactcgttttgctcatgcataaaagatacatgttaaatcagagaaaccaccctaagggtgattgatgaggaggacagcctggagagttacttcaagctctaagctcagggaacttggtaacactttggactcaattttgatttgcagttgtacaagacaatgaacattgctgttggagggggaccttgctgtatacactagaattcaatttagcaggaaatggcaaacactttagggaacccaaagaccatctccatgatacagggtttcctaagaggacttcctaagagggctgcacaatgaaacgaatgtgccctggaaagacctgctttctgcatagccagtgaggttttataagccatgggtaaaatgggataaatgttacctttgaaaagtatatgccgcctatgctcttcacatagggcttctaaatcactacacaaacttctacataccgatatatctttctgtgggagggatgagttaaaacaacctgtctttctctttctctttctccgcctgtctgtctctgtatttgtccctgtctccttctgactctctcctttgtctgtttctccctcttcgtgtgcatttctatgagtgtctgtttgtatttttctcagtgtctatctctgtctcattctctgtataacattccttctttcttgtccacagaattttttcttaaaagggaaggggactaatatagcatttactttttctggcactatgttactttatatacactatttaattcaagccattcagcaatcctaagaggaggaaaaacgtttttaagaaaaaaccaaaaacttttcttataaatcaggaaactgaagcttacagaagaattttgtccaaaggccacctattcacagaaaatggaagatggctgttcggtaatgagtccccgtggaccccggagtaacacccttcttagtatgtggacatgcttgcagagtgcaccttctccgtgatacaaggctattcttcctaatccatgggctgggaaatccatggcctaagatgcaaactgacctaacccacaggtataaaggcagcagagcaaccagccctccatccttcccacctccattcctttcctgccagctctctttttcacttcctgcaacctgattttcattcctgagacaaaataaatgtatccttcacagagttttctgatgttgaggacccaatgtccttcactcagtccttactgtacttgctctctgaggattgaataccatggagctcatcttcttaaactgctttttccttagcttctgtaagataatatggcatttgatttctatctattctctgtaaaaaataaaaggtaaaataatttgtctatgtaagtcctcacttaatgttgttgataggttcttagaaactggaactttaagcaaaacaacgtatagtaggtccttcaataatatcatttccttcaatgtaatgttttatcatgttgacgagaaaaaaaattggttttgtttatatgttgtttcacttaaagtcagtttccaagaatctactggtaatattagtgaggacatactgttcatatatgtatatatgtgtagatacatatgtacacatacatatatcagggaagtaaagaggacatagttggggaaaccaagcaacatagagatgggcacatactagctgcttaatatattaatttattgaattaatgaattaaccaactcatagaattatctcccaatcttcatctaagcaaatctttcactccagccaactagaaaagtgccccctataaatgcaatgtgttttcttgctcacattcatagacctcatctgaggtttttccctctttgtacaaatgctatttacatcctgaccgaaaccatcaccaacccatggaaaatctcctttgttgctgtgaattgaaacaactcttcctctctaaatgtttatgacaatgttcacctatttagcaatttatcctttgcttccctgtggggtttttaatcatcacttaacttttgtgttgttatttcactcctctcttgttgtcattgtctcttcaactaagagaaccatacttttgtgtcttcattgtgcccctctaagagaagatgctagtataaataaatgtttaatttattaatattttgaatgcaagagaccagtgctcctaagtattgctagcttttatgcagtagaatggaaaagagggcaataactaaattttctgagagtctcctctgtactagatgttttgcaagtatatcttgtttcattctcaccagaaatttattaggtagtttttaccttatttatacataaagacactgaagttcaaagttacttgatcagggtcattcatctggtaagttggaaagctggggcctgaaagcaagattcagctctaaagattacatccttaagatgagttcatgtcctttgcagggacatggatgaagctggaaaccatcattctcagcaaactatcacaagatcagaaaaccaaacaccgcatgttctcactcataagtgggagctgaacaatgagaacacatggacacagggagcggaacatcacacactggagcctgcggggtgtgggggctgggggaggaataacattaggagaaatacctaatgtaggtgacgagttgatgggtgaaaaccaccatggcacatgtatacctatgtaagaaaactgcacattctgcacatgtaacccataacttaaagtataatttaaaaaaaacctaaataaatgtataaagcaaaaaaaaaaaagattatgtccttaaaattgtgtcacactaaacaataaagtttctagaagaatacataggaatgtatcgtcaggaaactggagtaagcaaaggcttcgttagcaggacactaggggaaacaattaattggacttctttaaaattaaaaacttctgttcacctaaagatatcacaaaagagtgaaaatgtaattcatgagttgggagaagatatatacatccaggcaaaattattgaatttagaatatactgtatccaaaatatactcatacggtatccagaaatactttaaaacttaatagggaaaagacgaagtcttttgttcatttatgggcaagagacttgatagatccttgataaaggagaatatccaaatgggcagtaagcatatataaacttgctcaacactactcaaatttaaaccccaatgaaatgccactaccaccaccagaatggctaaaattaatacaatggataatagcaagtattggcaggaatgtggtgcaactggaattctcatatactgctggtggtaatataaattagtatagccactttgaaaatgtgtttggccttatcttctacagttgataaaaactacaaatttcatctactctatgacaataatttcactcctaggtatagatgcaaaaaatattagtgcgcatgtctactaaaacacatgtacaagaatgtttacatcagctttatttatcatagccaaagactgaacaacccatatgtctactgacaccagaacagagaaacacatttttgtacattcatacaatggcctacaaattacacattaaaagaatcaacaattcctaccttgaacaacataggtgagtctcaggttgtagagtgaaagaagccagacacaaagagtacattctgcatgatgttatttatatgaagttttaaaacaggcaaaacaagttcatagttataaaggtcagaatatttttttcctctattgggtgagggcgaagggtgttggtaattgactgggaagggatgggggtgaacctatggagtgatgaaaatgttccatattttgattggtgtgatagttatgtagtatatacatgtgtaaaattaattcatctgtacaattaagatttgtgcattttatatgttaatctcaatttaaaaagcaagtaatcaaccaaacagcactctgtcatggcaaatggaaatatatttgtaactataccagtttcctgaataagaatttatatgatctatccattttatattaataattaaggtccaaggaaaacatttgtctctcctgacactctggtaagattccctttatcagataataaaaccatatatcctgtcctgtctcacctgtgtcaggaagcacacacgaattcaatactaaattaatcattttagcctgggttttggtatatttactttcattctctctttctgctcctcactccccaaactccagcctcacttcccttctgatgaaaatgttttacgtatgccgttcagtacctcaaaaccatgttggatgtaggtaaggatataacatgacgtgctaaatgaacaaggtgcttagcgcagaaattgaaaggtggtataaaaggagagtaatatttggtgtcagaaaactttagcttgagtctagatgtccttttattacctgtgaaatcttggtttcaatttgttgaacctttgccccctcacctctaaaaaccaggctagtcctatttacttcccaggtattgtgaatatctcttgggataatgcatgtggggaaagcaccatgagctagaaagcatgggtactaaggttcacctggctgccaatataggggtacataggctgacataaagaaagcagcaggcctgagtgtccactacagcttgattatctcattgctctccatctgttgctttttctctgacccacatttcctttctggaacttagtgggtgttctcactaatgaacacacaccttctactgtcaggaagaaggagtctcaacaagaagcctgtgagagtgtcttaaaaggcttggctggataatgaccaaggaacttgaaccactggtctatcttgttttccccatctttagagaaaaagttcctggacactctggtacatccgattacagaagaaagagataagaattggctctgaggacagagcgaacaatcttttatcccccatcctatcaacggctatgacaattggtatccttcagtttttaagaattactacatatcagattccaagaagctcaggcaataacataatagacaccaatgtctcaaatatccttctggaagagccattgatattttgctaaatgtactaagatttatttcttgaaaaaaataattacagatagggttgaagttctactctgtatgctttctctttctctcccctcccttgaggcatctcatttctgaggttggtcaaagccatttgcaaatatgcttttggttttctatccaaagtcttcacataatatgctatgaggtatcattaaagttatagaaaatgcatctagccctatctatcctttgtaacttgcttttttcatttatcataatgcagatacaattcattcattttaactgcaatgatacaattcattcattttaactgcaatgtataaatgatcatggatttgtccatttgcttacaaataaatagctggatccaccccacttctgccatttttagctattttaaattatgctgcaatgaatatccttgtgtagatctcattgtttatgaactaggatatcccatttttaaaaaatctagaatggatgctgagaagcaggattgcttaattgtagagtatgcctatcttggaacaaattagatctctctaaagtggttataacaatttaaaacacatcttttggccacagttggtataatcacatttttaaatgtgtgtcaatagatgggtttgtaatggtatgctactgcaattttaatttcccctgaatcccagtgaggctgaacaaatttttcatacatttatggctgttggaatttacctataaacagtcttgtttatatattttgtacatcaaatggtttattagactgtttgaataattctggttccagaacattttacttctcccagaaaagctcaaccaatttctcttgcacttctaattttcagaagttttttaaaattgaacccaaatctgtattgttgatatttctatccagtacactggttttgcactctgggttgacacggaataagtctgacctttctttcatatcactgccttacatatccatttgttcattgacttattcattcattcattcacatacttactcatttattcatttcagcaaacacaaattaagcactcaccaaagtcaggaataaaacctgggtcaagtcatcaaggagacacagtttgatagaggagacagacatcaaattaactaatgatacaacatggtaagcccagtaatagtggtatgcacaagaaacaaaggtaggacagaatgaggatgactttaacagatattcaccctctcaccacaccatttattaaaatagacatttctataaaacttgcctgcaataagtatccactgtcatagtcctcttgtgtatctttcccccgtcacctggccactcttccagcggaggccccccaatatttctatatcaactaagggggtggcagggtgtgggagatacaccaggaccttatgcctgtgctgcagctggcctgttttgatgggttggtgcccagaactgctgttacatatttgactgtcatatttggaaggagctactttcacttgtgtcctggttacaggtattctcactgtcccaatcactctctgtcacatctatctttatccttcatacatgatagtgctcagaacaatacataggttcatggaaaaatagtctaagcacagtgtttatcaaacctcagtgtgtgcatgaaacatctacattttttgaaaaaattgtggatatgactcagaaggcctgggctggggcctgagattctgtatttctaacaacttgcctggtgatgccaatgctgctagtctgaggaccatattttgagtagcaagggtatttgcagcttaaaatgtagttgaaccaacaccaacataattctgacccaacaataacgacccagcccagtgtcaaatcagttatctgacaacagtgtcacactacagacatgtactgacctaagtcctgtactgacctaagtcctctaagtctttttaggaagagcaaaaaagtcaatactacttcatcttctatttatggagatatgtttttgtatacacgtatctctttgcagctacactagtttggaggctagtgacgtcgggaggggcctgtgatacctacctgttcctctaccgggccagtccatagagaaggtatacctagcatgcatccaacaatgcacctgagcttctttagctgtacaagggcccattgctatattaaagaaatcctccagggagctaaggctctaagacacatctttacaatgtttcattcattccttcaacaaatagtgcgtgagcattcgtacctggtggtcattgctttaggtactgagacaaagtgcttcctctcatggaatttatattctgctggggtcagatgtgctccaaaaatacatgaataaataaacaagaagaatttcatatggtggtgttatgctgaaaataatagcaagaggtgagggtggcagggtggctcctatggactgggcagtcagaatgatgtcatttaagctcagacctgcattattagcaggaagacgccatgtatagataataagaaaaaaaagggtcacaggcaggaaaatagatggtactagaatttgaagcaggaaagagcttaatatgctcacagactgggaaggtcagtaaactgcctggagcataatgaatgggggttgggatagaacacactgacattgaaaaggtagaaaggggttagatcctgctgacctacataagtcagggtcaggagtatagattttattctaagtgtgatatgtagccttagtgatcattgaggtttttggattttagaggtagactctgtaaggctccagatagaattactgggtagctactttttctgtttgtttttggcatcagcagtcagttggctgttggggtcacttacttggttggggaaagttgttgtatgggtgatgtttgaggagagaacacaagagtttcattggatcatggtaagtttcagatggctgccagtcatccacatgttggtggcaagctgactgttggaaataagagtcctgaagactcaatgtgctgtcgggcaagagcaaaagacctggcatattcagcagatggttcttaaggcatatccatagggaatgtcatactaacagattgatcagaggaggaaagaccagcaaaggaatttgagaagtggccagttaagtcagaggaagactgaagatatggagtcttgtgaactcaaagaagtgtttcaaggaggcagggcctgactatatgtgatgctactgtaaggtcatggtagacaagaacaagggaaaaccctctagatttggcaatacatagatcagtggtgaccttgatgatagtggccctagtggagtggtggggaggaaagtctgatcagataggttaagaatgtcagaaaggacgtaaaaataatgattgtagataataagctcaagattttatgtgaacggagtgaagagagtggtagttggaaggaaataagagatcaattttttaataggagaaccaagagcgtatttgtataataatggaaatggactagttgaaagggataatgtgatgattcaggaataaaggaagatataattgcagaagcaaagaccttgagaaggtgaaaaggaccgggatccagaccaaagcattaggattgatttctgataggcacagagatatcatcttcatagaaacagtactgaaagagacaggatagagatacagatagtttatttgggcagtgaaaaggtataggagtttctgtctgcctcaattttcttctatatttgagaaaaaaacataacccattctcaagggcaacaggactctcaaaaaaaacagacaagccaacacctagtgggaccccacaaactacaagtgaaaacaaaaacaaaagcaaaactctacatgaaagtgggcaagaaagaggtaagcaacttctgaacagagaaatggggagaggaaatgtgatatcctcaacagcataaaaatgtcttaaaattacggaactacgtcttatcctgtctcagttctcccacaccatttctgacacttaaaatggtgccattgacagccttctccccatatctggtctctcatgctggtatgctgaaactctcactcctcctccaaggaacatctcaaatatatcacccccatcaagcctttcctgatatccatcagtatcacccaccatcgatcttgccctactttgatttctcacagttttattacatgcttagtaaggtctttcttgtactgtattatagctttggtaggctttttggaggaaataatgatatcttcattgtctatgatgccttctaaatatttttcgctactctgacttacagtccagatattagctaatcctttgcccagataaggcttactcttttttggttctaagtcaatgtagttgcaaaattcagaccttcacatattcccccaagaattctagtctcgacaaccctgagaataatgtaagctgatgccaccattccctgctggcaggatttttttgggtacatgttgatggcctccagtaatgagatgcaagtgagagctaagtccccttctcccaacccagccactaggtgagatgctgcaatgaaaacatgtatctgactaatttctgcaacacatacatccttttattcatgagcatgtacacaattttttttctcatatgagatggcgaagcaccatctctgttaagacactttcaaaaggacccttgtatgaaaagattacttgaggcaaatgtgacatcatgtcagcagcagaattcagccagtattccagttaaaatcagccaaacaaattctctgttaagtggcaggtcataagaattattaaatggatccctaagcgagggccaccactagaaaggagcatacagcttttggacttgctagatcctcataccttatttattcaagggcagctgttcctgtgtgatgcttttgaccaatccacatgtcttgaagaccatccatttcaccaataaaaaattataatatttcttatgttaaccaacaaagtctctaggtagagatttaggtaaggagagttgatcacttgtcttggctgccattgaacggttgactactaataagtttctcttcagtgctaccctctggggtgtgtattcttctcaagggcacttcaaatgttagctattcctagggtatagataaaatcaacttaaacatatatagcatagggtttaaatagaaatattcaaaggtaaataatgaacacctaaattaataaatttctccctcccttttttctttccttccattttttttctctttctcttctgttcactttttccttggtcttccatactgaagagtgattgagtcattgtaaaggatattttggagtgcatattgtttccactaaaatttaaaatccacagacattgttgctctccaaagtccctccttagccaccctgacaccagcagctctgctttcctgaatcctgtcccctccacttgtggaatttcaaattactttcccatgtattctaactccctataacactctctcagcttttaacttgccaacctaaacaccaagattctcaggaaaacagagactcctccagagaattctggccggcctccttagaaggctgtttgtggaacatctttgtttactcaaacatgtccttgaggtctctaccttttctcatctccttagtaaacaactttgctgagcgattatttcaagcaaatgcaatgttgttaaaataaactaaaatggagaccaggcatgaaaaattctagagaagacagagataggccttgaaagtgaccttaaacttgtttgaatcgcaaccacaagtggaacttaacttgagctatttcttataaatgccaacattaagaaacatggaactttaactgaaccaatcaaaagctgccatctaacacagagttatgtaactagaagctttccagtaggacagacaaaacgaggcaactacataacccaaaccaatcagatatcttccttgccttgcttctgtgttcactataaaagcctccctcttgggcttcttcagtggaaccctgaaccacttgctgcctgattcatgagtcactgtttgcccgaataaactctatacaattttattgtgcctcagtttatcttttaacagtattcttctcaagaatgtaaataaaattttcctcaacctcattactaagaatgatgtttcattcttagtgtttaaaccttacaaaaggtccaaaattcatgtcatcccacatatattcttatgtacccttcaccctctacggaagtcacttactgttgacatgcatatacatcctcaagggctttcatgtattagattttttttttcctgctatgtgcacgcacttctcacttctttttgttgtccttgggtttacacttttagaattgtctcagcctaaggtaatcatgagaataacctggagattttgaaactacaaagaacgtcactagatcttttgaatcagagtctgagggttatacccagcacctgtgttttgtaaaaccatcttccctggtaatttttgtacacagccctaagtaagacttctccactatttagcgcaggaggatagcgttattgttttctttctttgggaaccacctgtggttagataattaaggcttttcagtgaccacaagctctggcacttgctccaggatcaactccctgccagtcactctcccagtcgtccacagcacaatccacagtgacttctaaggccagagaggcaagtttgcacttgttcacacatcatttttataccattgcttgtcacctgaatctcattcttgctcccccacagggagctggtcaatcttgctgaagagtgagtctgggtaagctccctcctaatcagagcaactcagtagtctgtgcctgtgcccgagactgctgacccttaaattagggaaactcaacatttgctagcttccctactggattaggtggccatgactgtttgatgctgcagctaggatgaactagggtgattttggcattgacgtttgtctttagtcacaaagctgggaactactgttggtgattcatatacacaaaatgaagggtgcagttcatcgcatttcttcttccaaggctctcatttgtttcaagttcatagcccaagtttctccttaccgcaagaggcagtccccccagcacttgggtggttaggtggatgacatgacttcacactggcatgggcgctgcctcacaccttagatgtttccacatgggcagactgatatagtgaagcaagctcgggctttggagccagactgatctaggttcaaaccccagctctgcagaacctaaagttctgtggccttgggccaatgaccatactttactgagattccatttgcgatccataaaatgaggataattaaaaaattaataatacctgcctcacaagtctaatggacttaagataatataaggacatctgttaggcaatcagcacctgctccttcctcctttggctcccatacaaaggagggtggggtccctcatcacacctcctgccttttttttttttttcttctctgagacagtgtctggttctggctctgtcacctaggctgaagtgcagtggcacaatctctgctcactgcaaccttggcctcccgggttcaagccaaccctcctacctcagcctcccgagtagctagctgggactacaggtatgcgtcaccatgcccagctaattcttgcatttatttgtggagactggctttcgtcatgttgcccaggctggtcttgaattcctgagctcaagcaacccgcctgcctcagcttcccaaaatgctggcattataggtttgagccactgtgcctggccctcctgccttgttcttagctgtctttctcaaacgagggcacaaacaacaataactactgggagaactttgtcaaagcatccattctcccacccctagatccaaccctctttgaaatctccaaccttacctccttctcctcctctcttggtgccttcctggaatgtttcccaggtgctggactccacggcacaacaagtgaagcactgagggtactgacttaaagaggcattcaccctctcccaagtcctaagcactgactccttgaattgtgggccctgggtgcctctcgctagtcttggccctgctagggctttccgtcgattcatcatttgctgcacggatgacaaccatttcttttctcccagtaggttagataaagcttagattaattaacagtagagcttaggcaacttttcttgctggagtacttacaaaaaaataaggggttcctgagagccacccagactgatgaaagatcagcctagctgcactttagactcacctgaagtctagacgctcagcttccagggattctggttccattaggctggggtagggcaacatgggtaattttaaaaagcttctcaggtgatttgtaagatgattagggtccaatcactggcccgggctcagggaatctgtattcaagctcccagatgattcctacatgcattaaagcttcaaaacccactggcttcctattaaactctccagctctgaaatcagacccaggttcaaatcctcatgtttttttgttttttttttttgaaatggagtcttggctctgtcgcccaggctggagtgcagtggcacaatctcggctcagtgcaagctccgcctcccgggttcacacaattgtcctgcctcagcttcccgaatagctgggactacaggcgcctgccaccacacccggctaattttttgtattttttagtagagagggggtttcaccgtgttagccaggatggtctcaatctcctgacctcgtgatctgcccgccctggcctcccaaagtgcgtgagccaccacacctggcctcaaatccttattcttgcactcactaccatattactttgagcaaggttcttacccgcttcttcacctacaaaatgacaataataacagtaccttccacagaagtgttcatggggattaagtaagatggaaataagttagcatactgtatgacatacagcaagtcccactaagtgataccttattaacatgctaaagcatttattgagcccttccttattgtggattagcattttatgtgtgtgtgtatatgagacatagtgactcatctccaggcctgtgactttgggctacttaacacctttgtgcatcaggagattataaacagcataaaagaagtaagtcatgaggattcaatgaaatattgcatgaaaagtgtttagtagagccctagtacatagtaaatgctcagtaaatgccagctgttataattgcacataatagtcaattttcaataaaagttgataattctggagtattcttaatacatttcctgtccaagaaaatacccagcttggctcctaagtaaagccaaagatctttcttgtgcttatttcttagattttgctataggggctggcccgcatcacgggtttaaggaaagttttctaaatgcacaaacgaatggattactagggaatttccacttgccttcaccctccacactgattttgcctgtgactcaagatcgtgaaagtcttcctgaccacggggccattcattccgtttccaaatgctgcaacccgcccatggctctaatcaagagcagaactgatttatgctggaagtggagtgagccagggaggtggaatcctccaccgctgatttgtttattgctgagtccttgaaaattgaatagggaggaaaagggaggtgtgagaaatgagttaagagctactccccatcacatttgataagaggttctttcactctggaagagtatagcttttcgttgttgttaatatgaaaatgctataagtgctacaaaaacacatgtcaagttccatgcctgtcttccacctgatggccaccaagagccctgacaatgatggaatagcaagctgcctggatttctagggcttaattaaggaactgtaacaggctatgctacaactctgtaatactccttggtaaatgactacagtagataaagaaaaattggtttcctccatttagcagatattgattacagggtttgttttaaaacatttagactaacttggttctttgttttatttattcacttccatgcattaattgaaagcccacggctcagattgtattaacttgatcgccctctactggccacatgctggagtacatgcctgtttttgacctatcctacaaaaactacagctatttttagaaagtattggccttttcaagtcaaacatactttttcaaggtcaattatgagtacggtggggagactcctgtatataaaaccccaaattgtctactctgtttttgaatattctgcttcctgaaagatctttcgattccatatatttgataatttaagaagaaccatgaccaggagccagaagatctgagttcacatgggcctaccctctcatctatgaaaggagaaggttgaggtaggacaggcacaaggcccctttttaatctctcaagctggggcggtagggactgcaccccatgttagaagccaggtgccctgcgatcgagtcctaatttgagatttagttctgattcccttttactcttgctataaagtgaataaggagggtatgaaatctccagggttcctttgaattccaatatgttaggactcaattcatactaacctcgagcacatataagtgacagggaggaattttcggaaagataattcctcttaaaacccctttaaaaggttattttttcttttttcctatgacaattttctagaaaacataggatttattcctcacaaagctccccatacttgtagctgaaactattgtctccacatgaacagtttgaataaactgtaacatttttattatctagaacataggagagaaaaaaatccaacaccagattctagatggagatttattgcagattcttataatttgggggggaaaataaaatgatgaggcccttcaagtccaagggagaaaagctggctctgagtccctaagcagaaacattttttaaaagctgctctacttccctccacaaagcagatctgcaatgtgatcggcaaccttttgcttccatcattttggtggattacccagtccctagacacagttcaaagaagacatttgctcaggtagggtgagcacagtgtaatcctccatccttgcaacaaacattaagagcatttaagaaagtcagagcaaggcaatgctggaagaacttcttttctactatgagaaaaagcagaaaatgccacatacaacaatgtaaaattgattgacttagcaataatctggcctagggaaaatttaccaagtttcaagaaaggaatttgtttttaaaaataaaacgtccttgcatttaattagccacgcacttattctattataagaataagccaggcactattctatcaggcactttgaaatgaataattgtatttgctttttaaaaatcaatattaggtgtatatatatatttttaatatatttttatatatatattttttatatatatatatatatatatatatatatataatatgtatatgatggaatactacccagccataaaaggaatgaattaacagcacttgcaataacctggatgagactggagactattactctaagtgaagtaactcaggaatcaaaaaccaaacattgtatgtcctcactgatatgtgggaaataagctgtgaggatgcaaagacataagaatgatgccatgggccaggcgcagtggctcacgcctgtaatcccagcacttcggaaggccaaggcaggcgaatcacgaggtcaggagttcgagaccagcctgaccaacatgctgaaaccccgtctctactaaaaatacaaaaaaaattagctgggcgtggtggtgtgtgcctgtaatcccagttacttaggatgctgaggcaggagaatcgcttgaacctgggaggtggaggttgcagtgagcaaagattgagccattgcactccagcctgggtgacagggggagactccgtctcaaaaaaaaaaaaaaaaaaaaaaaaaaaaagaatgatgcaatgagatttgaggacttcgggggaagagtgggagggcgcaagggataaaagataacaaatatggtgcagtgtatactgctcagtgatgggttcaccaaaatctcacaaatcaccactaaagaacttacccatgtaatcaaacaccaactgtaccccaacaagttatggagaaataaaataaaatactgaagtacaaactttttttaaaaaaaagtgaaaaacacaggatctgtatattaaattacaaattgctgatgaaagaaatcaaagagacctcaataaatggagacatccctactaggttcatggattggaggactcaacataataaagccatcaattctccccaaattaatctgtaagtttattacaacagcaacaaaaccaatactaggaagggagtcataggggcattacactcatgttgtagatgataattaagaagattatgtatcttccctacaaagaccaaatcccacagataatagtactattttctgatatttaaaattttgctctaagagattttcggagaaaacattcaagtccttctaaggatgctagggctgtatggatgcatacatgtgtatcttcttttccgaagggacaaaaaacaaaataaaccacatatttccaggggaaaaccaaagcaatagagtagagagaagaaatgtttgagtttgattctgcactaacttttccaaagcaagagttctattcagtgtgagtaccttccagaacaaggcactgtgtgggaaacatcgtagaaggctgtaatctttccccagatcatttcctggttggggaataaactattgcagattaatgcagattacattgtgttctctctgaggactgtagacaaaatagtggctattagtttctagggactggaaattaatagagagggagtttaatgcaagtcacattcaatcccatgagcaagtctttaaaatctatcaggtctagttcaaaaataggtctcacattccattattctctccatctccactattactatcttagatcagtggtccaaaagataggaacaggagcattgacagtgtgtttcatgactttcaggcagtcaatttcagagaaggcaatagcaaagaagaatcatgttcctttctgacttaaagaatttgagaccctgttcctattatctctggaatctagaggcatcacatcccatgcatcctctggcatcatgatcacagaagttttatctgcaacaggtgtatgaggagcttatataactgtgcatgctcataccctcctaatctcatccgcatgactattctgcaaacacaaagcataaaataccccagactagacaccggcatgagtccagctgaaaaaattgacagatcagcatggtctctgtataagcatgtgataaaatctctacagtcatgttttccaactgaatgctagctctccctcccctggatccccataacctttcttccattctctgataatagcttttcatttgctttctctgcctgttaaactgtaagttcctgtgggtagggagcaggtatgatcacgtgccttacttaactcagacagcaggataaaatgagtcctctggagtctcacagacctatcctggaaggccaactttactaactgtagggctttgggcccttaacctctctgagcctcaattccaataggaaaacagttattgtaagtatccaatgacatttatgcaaatggcttagccaatgcttgcccctagcaattgatgtgataaataataccactgtatcctaggttgggctctctagagttaatatttgagatggagatttgggtgtctgcgatttacctgaaggagaggtctcagaaagaaaggagttagggaagtaagacagagtcgggggaggagctaagctgaactctagcttcagcctgatcccacagggaggtctgaagcataaattgcaccaaaaggttggttccctcttgggatgggtccagccatttctatcctccccccattcaaaccctccatatccattggttactggctataggctgccttcctttgtgggcacagaaggacgtatcctccatggccaagcagctcccatggccaaggacagttccacgaagaatagggcagttgtgagctgacagtaacctatactcacagcaaccatgtaagggagatctgggaaaggcaccagaaacacccactacactattattatatttgtatcattctatgtccaaatatgagcttttgacatgacagggactcaataaatagttgaactaaattgaagaatctaaattgcatagactgtgcaaagccagcatgaatagcttttgtctcatccgcatattcaaaatctttggagacagctgtcacattcctccccttcactggccctcagaattgccaagactacacaaggttgtagcacacccctaaattcccaggcacactgattatgtatgacgctcacttaactgtaaattttcttgcttctcttgtttcagagattttctggtgctaattacacctacgcttacatccaaatatttcattgtgatgcagattatacttgtaagtgcatgaattattctttgaaggcaaaaggaattaataatgtttcaccattcactgtgacatgtttccaagcatgtaagtgacaggtgcacttttaaataatgtactttttcttctccttgacaagcaagaacccagatttaaagagatagaagatgtgaaggattgtcttgtggatctactgatgtcatgcttgggtttccatctccatcagcaaatgaacgaataagtaatgtatacaggtcccagtacctgctcagattagattgtatcagcagccttacactctgaaataccattaggacaaatccccaggcactcagggatagaaagagagagctgggttggtcatcagtaggaatggaggaaagctttttgtaaatcacaaggtgatttataaaggtcaattattagtattaattattctactatcaactttatgttcagtgctcctggctctacctacatctccttctgaattaatcagccccttccagagatttcacatctgttcaggtgactagggacaaataaaaaggagcctaaacaggttgaggaacctgctcttttcttgtacttttatctaatactctctctactggtagagactaaattgaattcagaaaacaaatctagcaggtggttctagagccttaattgtgagtggccaatagataacatataaaaggaaatggggattttatacatcatcatcaccctcatgaagtcaaggaaatgaatgcctaaagactagttgttgaatttcagaagattcatgtgtgtaaaacaagtggacctactgccccaattcaccagatttcattttagttctattaggatcatgaggtatttgagaaaagaagaaaaagaaaaaaaaaaaactcacaatttggtatgggcaatacaaaaagttctctctcacatgtattaatacatccactttaatggcaaaaacagactttaattttggaaaggaatatagctgagctctagattagaagcccataaactatggaccaaatctctcttctgcctgtctctgttagtaaagtttcattacaacacagccatgcccattcatttacatattgcctatgcttcttttaggataacaacagtggagctgaataggtgggaaaaagaccacgctggccacaatgccaaaaaatagttatatttggccctttatagaaaatgtttgctgactcttgctctacagccaaactccttgatattaaatactggttctatcacttattagctgtggtactttcagaaagtttctcaatgtaatcatcgtgaagaaatgaacactatctaccacttagggttgataggaagattgagtaagtttaaatatccaaagtgcctagaccagcatctagcatatattcaggattcaataactattagccattattattataaacagcaagaacaaatatccttctccccatacgcattgttggctctcatgccaaaagaaccacccagaggcccttctgccctttctcatggataagtttggaatgtctctccaatgttctgaatgcacatagatactttctaggtattctagttattctatagcagctgcgcagaagggaagccatttcttttcttttcctctctttattcttggaagatggcttcagttaaaaagctcaagcagagatttcaaacctccttcttctgtctaaaatatttaatggccagcctaacaaccctggcaaaacaactggtttgttttcacaactcacagtgttttttcatctttagaatcaattagaggttctaaagatattgtaggatcaaagattggcttagaatataaaccttgaattcctaagagagcttacaagtttgtccagattagatgctcaagatgaacagagggcccagcctctgtaaggtaggaatgtaaagtggggataaaattagtagaattttgaaaaacccacctttttgagaaatacagatgaataaatagattacacttctttctctctctctttcacttcctttccaccttttccttacggccaggttaataataaaaaggtcagtgttctgagttctaaaaaaaaatgtatactgatacccatatgcataaggcattgccctgggcaccatggagaaattcaatgtggtaaaattcccatcctagggagttaataatctgcttgagaaagcaagacaagcccatgaaaagttaaatagcaattaatgagttcaatgacagtacaagacaacagtggaaaagatactgctatgcaataagtaattagttgctaaattcagatagttaatattatagaaatttcaggggaaaataaaatccacatgatgtaaatttgttaaccaaaacacaagaaaatggccatcctacttcctcttactgaaggaagataaaaacactaaagttaaatatgtatttacatttcaagtgagtaatttgaggtgttttcatttaaaataaacattaattaactagcttcccaggctaacaatgtgtgttaatcagtcgctgaaccttgttttctaacaacttcagctgtaatgtgtaggttagaccaaaagattcagatggaaatcagaacaccaggaatggtgaagtcttagaagaaggcatgctcctgtagcaaaaacaggaggatgggatggggtcctgaacagcatcaaaaggcccacaagttgacagaacatagctgaatatcagagtagcctccccagagtcagtacgaatgaacaggcatggctgaattctaaaacattctagaaagattaagctaaaacatctacaagtgagtctcctgaatgaagcttctttatcatattcaccaattcactgcatccacccttatttcctagatgtttggggaagaggcttatatccagatatgccaccaaattcaaatttaactacaccctcagatttctgctccttttggaccactagagttcttattttggagcttgatgatctgcttgtataaactccgtaagcatagcagtaaagaatgtgactcccaaactaaactacctaggttccaatcccaatcccactgctgtgatctggagcaaattgcttatccatccactgagcctcagtttgcccagttgtaaatgggaaggatactagtattaaactcatacagttgtcattagggccaaatgtgctaatacatgtgaagctttttgaactatacatagtaaattccttataaatataagctggcataccctgtcactgctaagtaagagggcagaattagtaattcttttaattacttaacatgccagctatagaggcaacctgcctccttctctgggaccaacactggtcctacaaatggagctataacaagttggagtttatcaatttggtagtcttctttctggccttgtgtgtatcttaccccactccttccactaatacgacctaattataatattataattaattcaaaaattgtccttcttcctatcaggtcctggctccagactacctgtgtttctctggaaagagctattagtgttgaccaatgtcagtgattctaaaaactaagtcattgcatcccagccattctccatccactggggccccctaatgctatgctctgccactgatatatgcaggaggcagataaggaagggtccccagagaatttctgacctgccccacaagtgtttacaccagatgtttttgtgcagataagggaacctgcacagggtctttcctgggcatgcccacatgcactgaaggaatggagtggagccaccaggaattcacaccttatgcaggggaggagcctggcctcttcagctcctgtgtggtggcctggtattcaatctgcgaggtgggagcctattggcagggccccttctttctttgctgagagatttattttcgcctaatacaaccactttcctcacccttcaatgtgtctgtgtgcctaatttttcctggtcttgagacaagacctagattttagccaagctaaggagcaaaaaatcctgcatcattttggtggcccatatggggacctgaggaagggtgagtaaaatacggacctgaatgtttctttcccttttgttttggagccttcttgttctcagatttcttctaaaggtagaaaaaactgagacttgccttgtcactcttgggggtcaggaatgttggcctcagtccagcccagttttttctatggcaatttccttctttttattaggactgtaatggcagctatcttttcttttacatattggggggtgttccacccccaccccaatggccacaggtgcatgcacaggacagatgggtgagcagcagctccccgcccccctcccctctcggttggggctggggcacatggcccaagggccctgcgtggctggctggccagcattccctgccatgcaccgggagtcttcccctctcctggccaaggggtccacctcagtccaacagcaattaaaagtttctctcagctgggcacagtggctcacgcctgtaattccagcactttgggaggccgaggcaggcagatcacaaggtcaagagatcgagaccatcctggccaacatgatgaaactctgtctctactaaaaatacaaaaattatctgggtgtggtggtgcatgcctgtagtctcagctgcttgggaggctgagtcaggagaatcacttgaacctgggaggcggagattgcagtgagctgagattgggccactgcactccagcctggcaactcagcgagactctgtctcaaaaaaaaaaaaaaagtttctctccctgttggagaaacccatttacataagaataagaggttattcccccaggcatctttccagtcctgcacttaaactattattattttcttcttttttcaccctatcaggagttaacttttgtgtgagagatttttccttttagaaggtgtttttactaggccaggaccccaattcacaagatgctcttttctctcccttgttggaggggaacttggttccacagctttgccttaacattcagcttataaggagtccatgaaaccccatgagacacatttttgccccaaactccattccaagctttggaacttgaaggctactgacagcaggcgggacatggagttcatgggtaagagcagataatccctccctcaggcccccctattaacatgggtgaaagccacattgacactcatgggcagcaccctgtcatggccactgggattcgggaataaaaagatggaagaaggaaaaaggatgctttttccttctctcactcatatagcctgggtattcactaaaaagagaaagggaccaggggtgcctgttaccccttctagatgagtagccattcatctttagtctagttggcttggagttgagctcaggggaaaggaacccagaagcctgacatgctggcaaaagggtaaaagtttttaccagttgggcttttggcttccctctccctgtgcacaccagtaagaggaatgataagaatcactgtttatattatctgtgaagttctgattaatgaaaaaggatatatgaggttggtcttaagctgtagccaatctggtatgctttgcgtgtcttaattgaggtttgttggtcccactggtgaggttacttttgataaagttcaaaagctagatacatcagctgcttggcatggctaaagtgaactaataagggatttaaaaggattttcttaaagagagctcagcttaattagaagtgtatatccaagttataggtatatttaaaaggcctttatgtttttctcttcttgaatcttattttgctgaaaaaagggttttcctcagttgactgaattatttttctccattttgccttgccactcttaatgcatgcattagagcccctaagataatttctgatggcctgggactccttgggaaagacagaaaagacaccacggattccattttgggagaaacctctgttttcctcatggaagcccaggaattagaagcggataaatccctctcaaaatctgtttttgtcttccagctatacctgtttattgggccctggaaacagcatgctcttaaagggctccatcctgaggcaaataatccaattgggattgttgagattgggattttttttcttttttctccaccctgagaattgagattgacaaatgaaaaattttatagctactggatcttcttctgtctgtgtagttatatatgtgttgtgtgtgatgtctataaaaaagagctctaattaattggcttaaagaaaaataagcacttagatcaaacttagtcaaactttattgatgcctagcacataattaaaacaacttaccagattttacattacagttaaaaattcctaagagttaccactataacatgtaattgagaccactgaaaatggatttacatacaaggtgtgtaagaacagtaaaatgtgtttttagtaaaagattataagagggcatggaaatgtaaatttttgcctagggctaaagaattttttaaaattagataagataaagctaaaggtttaaacacattgtggaaggtttctaagaattaatcttgtaaaagaaattctgtgtttgcacattgacaaaattcaaaggggtattatatggttttaattcaaaagggtattatatggtttttctgcaaatggaacattgaagtaaaagcacaacaaggttttcttaaggcactaatctgctctttagcaaaatttgtagagggttataaaaggattataaggatctcacctggtggttaaactggttaagataagatagaattgtctgtaaagtttcattagaaaattgggatagacgttaatagtaagggtaaaattactattaatgtaagggtaaaatttggctttctctcccttgtacaagattttcacgtactagtaaaggataatgagcgattttcatttgccttgtggatagactgccaaggaaaagaaagagcagacaagagaaaaattttttggaaaacaaagtcttccctgttaatgagtaaagattttctgccttgttttaaaattcctaagtcatcgttttggcaaaataaataacttatggtaatctgaaattctattttatagcatcaagtgttttaaatttttaacatatttaacaggcttccctgaatcaaatttcagcttcaggttgtcttttctgacctcagcttttggatgctacagatggcccctggagcacccaaaagagaggtaaacaggattatttgacatgttgaggtacatgggattgccaaaatgatgtttaatcttcttcaggttataatttagggaataatattaatatatattccaaaattgtatgggatttctaaaattctaatgtttgggtatatgctatcaatcatgattaaggttgatattatgttaagttattgtaaaccacagagataaccaaatttctttgtcaatcgtgtttttgactgtaactaccctagaattttttttattcacaggcaattgttgtcttgttttgatcctgttcaaaagatggtttataatcagctatagaactttgacaggtactctcaaatgcagatttcttgtaattttggagattgtgacattggaataatgaattcatgaagagctgaaatgttcatgaatatcaaatagaacaagagttaatggaatggactgaactaatagaaaactgaagtagcctttttaaatgtttgcttagaacactgctgatccttgttttgtttttcagagtcaaggaaccttatgttcagctatttatggcctttaataattgaataaagtacaattctgtgacaaaatttggagcatatttgtttctctttgcctggtttctccagaatttggaaactagtcatgagtattcatgacttatggcagtattcatgacttatggcaaagtagttatttgtgtcagtgcaataagaatccattttcttttgcaacagaatgcaagtggagaaactggttgttttaccaaagctttgactggaagggtatgcatcccgttaaggaatcaagcttgacttgcagagctgataaaagtcccttgggaaaactggcctcacaccttgtattcacagtccctgtacagggttcctgacccatggtaagtaaagaatgttgctttctaacaagtccaggaatcacatgttcttggacctcaagaagagaggagtttatgcaactcaggtatttgagggtacaaactcatggctgggctcagctttaaaaaaaagaagaaaaagtcttatctcagattccttgtggaacagagttccatcaaagccaatctgaaaggcctatgtaaaaataattatttgtgctgtactttatgcaaataatcaggccaagtataagactaaagtctatttttcaaacaactcagtcccatcatgatttctttttgacaagaatgaggactggagagagataaattatgttccaaaacttagacatttgtcattaaattctagactcattagctgttttaattttttttcccccacattataagttaactctgattattcctgtgaaccaaccagtgatctccaactgcagctcagaagaaacaaaagagatgagtaatgtaaaaatctggatcaaatagtctagttctgggcaattaccttgcaaatcctggcaggtgataggagtaaatagggtgcccatcacccagaggtatcctttttgagaaaataagaccaagggagctaaccaaagtcaagccccatgcacccaaatcttagcaagcataactatagccaccagttatctgtgtgtgccagcagccttgggatttttgagctgcccttacccatccctttttgtttcattttgatacatgttttccaataacccagtttgtctcttctggccttcaggccatcaaactccaaatactccaaatagtcctgccaccggagcctttgatgatcaccccttttaccagggacccttatataggcctatgagggagatctgattgctgattccccaaaacagcacccctgtcagcaggaagcagttaatattggtcttcatccttaaccttatccttatccttatccttatccttatccttatccttatccttatccttatccttatccttatctttaacctaagggcatttagatgtacttctaacctaagggcatttagatgtacttctttagtagggggaatgatagatgcaggaggcagataaggaagtgtccctggagaatctctgacctgccccacaagtgtttatgccagatgtctttgtgcagctgggggaacctgcacagggtcttgcctgggcatgcccacaagggactggtggcccatgtgcactgggtcaatggggtggagccaccaggaattcacgcctcatgcagggggagaaggctagcctcttcagctcatgtgtggtagcctggtattcgatctgtgaggtgggatcctgttggcaggacccactctttctttgctgagagcattcttttcacctgataaatctacctttctcacccttcaatgtgtctgcatatctaagttttccttgttgtgagacaaggacctggattttagctgaactaaggaggaaagaatcctgtatcattaccttctgagaacttgtttatggtaggactgctcaaatgatgactacatattaacctggataccttccactgttctgttgaaatcttcacccatcacttccctgcctccaagaatctgactggtttccatgtctttgccatatgtggtttggtgtctaatctacttaaatgctgtcagagttttccatatagcagatagcctcaaaaggctgaatcacctcctctcttgcagacgttatggcaaatacgctaagaaatccttccaagcactctcaaaggattcaccttctctgcctcatctctggttagttggtttgacaaaatgagaagacgagggtgacattcagaactccttgattctgctattattggcaaaactgtctcattagcattaaaatagggagaagacctaggttggaagggatattgcttaaaaaagaaaaaaaaagacttctgcttagcatgcaaactaaagcctaatacttagtatgtgctgcagaacagagttgctgaatagttctgccataaatcattctacaatgcttaggtatgtgaagctgtaaacccattccataattttcattagaaagagaccttcatttcaaaaaaaaagaattgcagcccctcagtagagatcctctggaaatcacataaaatggaaaaaaatgagggaatctctatctatctctaaacacacacacacacagatacacacacacacacacacacacaccagggcaaaatattaacttccaatcactgctagaaggcactaggtcaatcacagctcagaacacagtgaaaattgtgttacaaaagcaagcccgtctcccagacaatcctgcccctgctgcacacctgtgctgccttctcatccaatggcctccagaaacctgtaggcaagaagctgatcattaggagccttgacctactcactcgtccccaacctctggtgcatctctcagaatgtagcaattattatcctagcaccaacagcagcaaactaacatctcacccacaaatatacttcttactgcctttcatcgtgtagcaaatatccttttatgcacacctcaatcagaattacccaaacagccattaacacagcttggagagggagaagagtaagaaaaagttctaaaaccagacaaatcaactgcaaagtcaaatttgtattaagaacccacagatgctgggggctagttgatggaagttaggcaggtaaggcaaaatttaaggtgcattaaaaagctcagtgactgagatagataaattatattctaatgcaatacattttttaaaatagaagttaatacagataaattcattgtgaaccaaatatcaaaattttaaataataaaattcagcagtaccataatgagccattttaaagcctaagacaaaagagaaaatcagtgatgctgatcgtgttttcattaaatatttggatatttcattcatcatggattttttttgcatgaagtttgattttttaaaaatgttttattaaaatattacatatcttgatttaggagtttcctggtggcaccctcttaaatttgcacccaaggcaagctccttgcttatcccatgcttatccctgccctgctccaaattactgataattcttgtatcactagaaagaacaagtattgtcttctgatatagccttccataatattgctacccatcttatcttaaaaaatcagaggccccggaattagtacaagtggaatggagggcagatcctacttaagcattcttaaacagcttaaatacgcctcttgggttcaactgctatggcttttattcaagagaaactgtaattggaaagtcacaaatttaacattaacttttccatttctgctgtatgttgggtttagtttcacaaacaaggtccttttagatcagtaattcccaggctttataccatcaaagactctttttctccccacctgtaaccagggcttgtgttttgaaatactttttttttgccaaacatttatgaatgaatttatgcataaattctgtccaccatttaataggccaagatatctgaatttgccaatcatatattctgatcagtgggagatcacctatgattgccagagggaaccagcacaattgtgatcaaaggcggagatacttgacctgcaactcagcctgccaagcttcatcaaggatgccacaatttcattagatattttgaaatactgagttctcaaaaataattataatgaaatattaacttaaaagagtgacatgaaagaaatggtaggtataccatgttttcacctagctttataaaactgtaatgtaaaaaagtttggtatagtagtaacaggattacatatatatgtgtgtgtgtgtgtgtgtgtgtgtatgtgtgtatatatatggggtgtgtgtgtgtgtgtgtgtgtgtgacgttttcatttaaaagttgaaaaataatccagatctccattaccagctttctagttctttggggacctaaggacctcctatgtaggaaccattgttttgttgaaacaaatcagctatggcaaacaactgaaagagatctggtagagcaatgagtttctgagcaagtatgaatgaatacaaggcttataaatgtatggaaggaaagcagaccaagggacccaaagccattgatcgaagcctgacataattcattaagaaaataacatttccagaagtttttcaagattatctactagaatgtaagctctctgagttgcaggaaccacctgtgtggcctaatatcctgcagcgttctccctggacagactcaatgcatatttattgaataaataaatgaatgaggagttccttcttttatcaccattgttttaacatccgaataaactttaaaaggcatcaggattagaaaaccatattaagatagatatgggcatccaataggagcagacccttgggaccctgtttaaaaaaagcatcttgtcaagaacaatcattaagagacattataaagcacctcattcattcacacctgttggctaacaaatcaatgacatgttccacagatgcttcctcttggatttgtcccacttgaactctccaatatcttgttcaagatagtatacaaccttaaccacactcatttattcttcattttcactatggtgctccatcctgtatttcctgcctctccaacacactagtttaccctctctagtcctgcatttatcctctctccttcatcccatttcccacctacagaatttggtccagcatgggtaatttcttgcacactttttgagtgattcctcataacaattctatgaagaaggcaatgcaaaacttattattggtcccattctatggatggagaaattgaaggttagagatttaagagtgatgacctcagatttcagtaagtgatagatctgggattcagaaccaggtctcctttccccaggattctgttacattaccaaggacctcaacatggtatacagcatgcagttgctcaaagcctgacaaaatgaatgatataagtcatgtaagaaggttcagatgatactagagagctctatcttcctgtgcctatggaataaaaatataattctttagcatgatatataagatattcataatttggcttgtctgactttcctgcttttttctccatgactgctcattattcccacagtacccaaaccatgctaacctggcaggatcccttgtcctccaccttcatgcctctaagcctttgcctatgctgtttcatcctcaatgcctctcccaccttgttcacctagcaagttccaactcatccttctagaacctgttaagtatgacttaggaatctttctcactgaatgaggcttgctctcctctgtgcccacaacactgttacttcagcagcttccacagctctcaggataaggtccatatctttctacatggcagtcaaggcccttcatgatctagatcttgcttacatcttcagtgttttcttctcctatacctaccatgccctctgatgctattatctctccataatgaaatacttatggttttcacatacacatcactgtctgtctctcctcacagcttttgcacacacagctccctctgcctccctcatcacttttgctaggaaaatttcaacttggtgtttgtgaggtcttagctgacgtgtcacattcttctggaagcccgctgagtcagcgttggtgtcagtcttccttgctgcctgagtgcttccgccatcgtggtacctccttgctagtgtctcattgataagtacttagtgactgacttttccagtgctactgtagtgtgaaggatcccccatcaggttacttaagggtgtatatccactgcctgcatcttgacagccggctggttggtgagctgaggtcacggtgaccagccaaagagcaggtgtccctgagaacccaaacatcccagagtatctaagaacctatcaaggaaaacagtcccatcatgcatgcacagtaggcctaagagccagagaattagcttaaaagcagcttagaggtgggaagtggggcggatctctagaggtgccttcctgcctgccatccaggagtaccctatatgtaaatcttaactcatctgcttgccaagctgcacttgtccaaatcattcttcggtctcttgataccttcctagtttggggatgaaggtgtttttcccataacagttatccttatagttttttttcttctttaatatatttcctgcctttcccagaagagtctgtgatcagtttctcctttattttccttattgtagattcatttccatcttttcaggttccattcttcacagagtgcttccattgtttgggggtgactgatgtttgggggtgactgattgagggtgactgatgctattgtttgagggtgactgatgtggtggaaagaatgctggatggggtgctagctcaggctcaagtcctatccattcactcattcattcattctttcaacagctatttacagaatactttctacctaagtgctaggtactattctaggtgatgaagggaataagcaaagcccctgccctcaaaaggttttccagtaagggagttagaccagattaaaaaaagataatcacatatacaatgtaatatatactagtggtaagtgttatgtgaaaaaacattgctatgatattgctcatcctatcctggacaaacctgttaaagctctctgaaactaaatgttataaaataacattctaaaatggtgctaataatatctgctctaaataactagcaagggtggctatgaggctcacatatgaaagaatagaaatgcatttttgaaaacagatgaagtatatgcctttattgttattattttaattttgatgtaatgcagtgtctatttgccctttccaagagccaacacatgaattttaaaaaaatatccatcagtcatttagatgtttgaaaatgagcaaatgtctggctgacagcctcggtcttcatctgaatgtttggttaacctatctgcatggttggaaaagtcatgcgtttactgctgtgcccttgaaagcatcaatctctaggattattatttttttcttacactattgagataatggtaattttcctgtctaaatataaattttaaatgggcattttcatgcccactttgaaaaacaagctaagcaggactgtccatctcacataaatgttatttatatttctatgtagctcgtttttatttggggcatatgtgaattccaacaatgtgtaggagaatattaaatcattacccatgaaacttaggaatcaaatttaattttgcaactgtttgcaaaatttcaaaaaattgcagcatactttatgtagctttataaaggattaatacataaaaataaactaagcaatgccttttctatattacattttgctaaagaatgttttgatgtcaacttttttgaaagctgactagaagtgaggagagaatgtagcaaatagaggagagcactggcctctttacttatatatttgtatatttatttgcaattatacaataagatgtgaacacatgctcacaataattcagacagtaattaaaaggctcaagttccttttacctattctgttccctcatcataaccttaccccaaccatgaagtgattactgttatcaatttggtatgtatccttctagaatttttagtatgtaatcacaaacatatatatggattttacataaatagcacgctatacatattgtccagcaagtttgtttttgacatatgtcttggagactttaccatgtggggacatcgagttctagcatattctttttcactgtggcatagtattgtattacatggatccactacagtttacctaccccatttctggtgggtgggcttttgggctgtttctgatgtactatgctgtatatggttcccagcacacatgcatgcatatttctccagggtatacactgagaggtataattgtggcttcagaagtattcacttcctttcctccatttaaatttaaatagacactgcagacttgccctccaataatgaagtaacaatgtacacttccaccaacagaatccactccagttaagcatctctgtggtattctagggaggtagtcagttgggcagaagaggctggtgtcctctagctctctgagggttatgaacatacattcagtaggtaaatcccaagaggtgaaaggatctcagctggcaatggttctccccttttcatttcactagagtgaactcctttttaatgcttctttgtcctttcttatttcggtttttagctgaaataagatgtgacatgctcacaataattcagacagtacttaaaaggctagatctttgataacagatatcctgtgaacctgtgtttcacctgaccattaaaatcgttctttggaattaataacaactaccgttgattaactgacacacactttggatgtactatctcaatacatcctcaaaatacatcctcagaataactctgtaagataggtattgctttgatctacatttttcaaatgagtacacaaagaggtatgtaaatctacccagggacataagggctattaagacatagagcagaaatctgaatctgggctgggtggtttccaaccccagttctggggctatgagccactgggctctactgcaagcaatcattcccttctctgctctcctaagcctgtttatctctgcctcccttgcatcaggcattgctttctaccttttattagttatttgtcaataggatttatcttatcttttagcctgttagcttctcaactgaaaaatgcatggatgagtcacctctgtctccaagaccatttcaaaaaatacagtacctcaaacacagtaggaacttgataaatatatcttgaaagaaagatgtacttaccactcagcttcacaaaacttctcccttacaatccaagatcactgactgtccccctgctgaatctgacaatggccttcatgggtcgtccactgtggcatcttttcaggaggtaattctcatatcagaacttctagatacgaatggcttctaatcctatctctaccactgagaaccattttctttatggcccattctcacacgacaccactgatgcaggatctgatgtcttcatgtgagttaatttatctgatacgttaattagaattaatttgccttaattgatcaattggagacattcatatcttgcagcccttcacttctaaaccctgttttctaactttccctcccagacctcttcttctagcatttaaccccagattttagtcttttgggcatgcctttattctgctttccagctcagctgctgagggaaatcctgatttgactgcctggcttccatggcagctaaacatctggatactatcttttgaatcaccttccaattcatgctctaattcccatgggtgaatcacaccctacccatgactaaggcaaatcctcactatttcagttagacccagcatcttgagttcctgtttattcgaatggtaactgaaataacatataacaaacactgtaacaaggactatcagtgttctattgaaagaagtggccctcgtgtaaagaagactaagccaccactttctcctctacctctctgtagcctactcatcctgaaagccatagtccatgttgccttcctcaactgtccccaacagttattaggatacttattaacttctgatattcatcaaccaaactagcatttaattatatatggtcttatattgttttatgtgatctatcatctcccttattaagcaaaaagcttcttgtagcagggaacaaacatattgccatactctcctttatcatcattgtcctcttcaccattgcaaatattttctttaacttattgagtgcagaatgctttacatgaattaattcatttaatcttcacaagaacactatgaggtagatgccattgctatcctcgttatggatatgagaaaactgagcacagagaggataagtaacttgcttaagatcacatggatatactatgtggtgaatcaggtatttgaatcttggcagcctggttctagaatctaagagcttaaccagtgagactttctttcatgtgatccttttatagtaccaaaaacagctgagaacgtacatagtactaaatagtaataaataagtacaaagtaagtactcattagatgcctaatttacagtttgatgcccatgggcttttcagtgtccttgagtcctctctatcatcatctcaagactcaactgcatatagttcaactacttaacataggcctggacacagggaaggggtcagactggaacaagatttgttgacaattctgcacagaaaaggaaacagtcaacagaataaagacaacaccagtagaatggaagaaaatatatgcaaaccagatatttgataaggggttaatatccaaaatatacaagaaactcaatagtaataaaacaactcactttaaaaatagccaaaggacctgaatagacgtttttcaaaagaaagcatataaagagctaacaggtataagaaaaaatgctcaacatcactaatcattagtgaaatgaaataaaaatttaaaccacaatgagatatcaccttattcatgttagaatgtctcttaataaaaagatgaaagataacaagtgttggtgaggatatggagaaaagggatcccttgtgcactgttggtgagaatgcaaattaatacagccattaagaaaaaaagtatggtggttcctcaaaaaatttaaaatagtactaacatatgacccagcaatcccacttctaggtgtatatccagagtatatgggatcagaggttgaagagatatctacattctcatgtttactgcagcactgttcacagtagctaaaacatggaatccatctaaatgtccatcaattgatgaatgaataaagaaatgtggtatacacacaaatagaatactatccagccttaaaatagaaggaaactctgtcatttgcaacaccatgtataaacctagagaacactacattaattgaaataagtcagaaaaagacaaatatcgcattatctcacttatatgtggaacgtaataaagttgaactcatagaagcagagaatagaatggtggttactagcgactagatggtgcagggttggggagatggcggtcaaaggatatacatgtctttttttcttctttctttctttttttttgagatggggtcttgccctgttgcccaggctggagttcagtggcactatcatagttcactaaagcctcagactcttgggctcaagtgatccttccacctcagcctcctgagtagctgtgacaacaggcacacaccaccaaaggatataaatttcagttagacagcaggaatcagttcaagagatctattgtacaccatggtgactatagtgaataactatgtattgtatactcgaaaattgctaaaggagtagattctaagtgttttttaaaaataagaatgtgaggtaatacatatgtataattagcttgatttatctatcccacaatgtatacataaatcaaaacacaatattacatatgataaatatatactatatttatttttattttatttttttttagactataaacataaatattattgtttggcattaccccaaagttcccctttaaaaaaacaaataaatggaaataatatatatttgagtgttctgtctctactttctttgaaccaaggaggcctcatactttatgagtttgttccaccctcttctaatatatctgtcaacagagcatggcaacagtgttacaaaatttaatgttttaaaattttgaacaaattaaaaacatgaaatttatatttctcttacattttactattctctaatgagggaaaatgatttaaattttggactaaatgcaaccagcatataaaataattctcttctgagtgatagtgaaacaattactgaattacaactatatgcagaaagtatttttgcctaacatgttttccatgtgactaacattatagctcattgcaagtggtttatttgttttataattaataaagaagtccaggtggagtttaacacaaaaacagaagatagagagcatttaattttgtagagagctttcagtactaaaataggtagtcagaattttctgactttaatggagtcagaaactgggtaactttcattcttttaacttaaatcagtttctggatttagtttatcaaaatagactatattgtatgtgtattggtgaactagaaatagatcagctctcaagaaaatgtggcacatatacaccatgaaatactatgcagccataaaaaatgatgagttcatgtcctttgtagggatatggatgaaattggaaatcatcattctcagtaaactatagctaggacaaaaaaccaaacactgcatgttctcactcatagatgggaattgaaaaatgagaacacatggacacaggaaggggaacatcacattctggggactgttgtggggtgggggaaagggggagggatagcattaggagatatacctaatgctaaatgatgagttaatgggtacagcacaccagcatagcacatgtatacatagcacatgtatacatgtatacatagggcacattatgtacatgtaccctaaaacttaaagtataataataataaaaaaagaaatactatttttatttttaaattaaaaaaattaaaacagcttgtccccaagagctgtggaagcaatggagaggcagactcagaggaagacgctgcaagagagatggtttgactggagaggcactgagcatgacaacaacaggatatggtccagatgtggcagacagtaaagcacatggggggctaagaaaatggactttgaaagaggactgcctaaactggaatcccagtgccacagagtgctactcatggaactgttgtgagctatgtgagtcaattcttctaaagtactaagcacagtaaaggagaaaggtgtgctgtacctgttaactgctatattattctgaataattagaatgaagaccaatatctgacttctgggtttctgacttatatgtggggcacagcaacagggaatgaaggcacagtgaacatgcagaattcagcatctttcctcaggctctggccatctgagcacacttggttttagtgaagttagcttataggcagttctagaaacaaatttagggaggatttggggccctaagcctagagattccaaggtccttgtataggttaacacaatagaaatgcatgtaccaggtacagaagagagggccctcatcaggactggggtacaaactggggacttggtccagacacaggtgacatctcgtggctcaaccgaggcacaggaccacagtgagacaacagcaagggtaccttggagcagagcctaatatatggggtggaattacagggcttaaatcagtgctacctcttctcaggagtagcgcagaggaccatgggcaggctgagtatgcagataaggattatatgactccaaaggtaaggaaaagctgggagttgggctggacctaatccatgttgcatggagctgcttcactgccctgtctgggcctcaccttcttggtgagcaagcaatctggtaccatgccctttggtgaaatcaggcatggaacaggtgactgaccttggggaacgaaagccaagctgccattcatcacagcccatggtgcaaacctctaaggtaagccttggagcctccagcgccccagcggtggggcatccgtcctctgggcagggagcttcaattcacacagcaggagagccataacatagcaggagacacacagaaggcctttaaatgtctattttttaaagtggttagcaaagcaggagagaaactgtcagagatccgcaatgcagagtttaatctggaaagtcagtgaagaggtggaaggaaacagaaaacaggagactggaagaagaggcttcaggatttggggagagcaaagcaaaaagtgttaacaagaaaaaaaaaacagttgcatatcagaaactgctcaattctcatgtcaacatttacagaacactgttttccatttttccgactgctctatgcatttgacaaatttttacttgttcttaattctagctcaaagttcacctcctttagacaaagccataccctcttctggcctctgttttaatagatacaatgtttgtaatagcatatttcaaaatattgtgtaatgaattgtgactctggatattatagccactcatcattttcttgaggatatttatccttatatccccaggacttagtaaagttcctggcacatattagctaatggtcaattaatggtcacttaatgaatagaagattaatgaatgaagaaggaaccaaggagggaagatgctttatgactgtacagggtgcatgcgaggggaggcaggaagtgagatctataaaggtgtcttagcatatcatgctggtgatgtgagccaagctaagcattgcagctttcatccactggcaaggtagcataataaaaggctgtaaagcagaatgtttcaaagagctgttcccccagtgccatcttcactctatacgttattaatctcatttcttccctacttcgaactaatgtgctcacattcaaagatttggcatatatagacccattcaaaacaaaatgtttcaagttctccagaaaataatcctaaacctcaacttcttcaagaaataatcctaaaataacctcccatcagcttctttgttactcagtattttattcttaacttattgtaaccttgtacctatttatttgtcccttgggagatgatggttttctttaagagttatgagtgtactttctagtgccaaacttgggttcaaagcctagctcatccacccacaagctttctgtctttaactaaattatttaatatcactgagtctcagtctgttcacctctataggcatgataaataatgcctacccacatgatttcggtaagaattgaaggctattgtaaagtttaaacatgaactaaacaatcaataccagcagctagtaatagtggttctgccaatattagttaaaaataataataatagtaagtttgttcttatgccctggcatactctctgggagaaagaatcatcttctctttcttaggttattatttctttttctctcccctcctacaactgcacatctgcctcttcccttcacagtattttgcaattctctgtgtgactcaaagcagagctcaggttatgcatgacagctgcctcttccactgtgccctggcaccatggatgtcactgccatcctccaccccatgcatgagccagaaccctgggctccttctgactcaccattctccctcacccccaccatacacagttcatcaggctctgtgaatccacatcctgaacggctcctgatgctggccattgctctccatgtgtgccatcaccttcaacaggttacctgcatctccaacccagactgccaccagagcctcctgactgccctcctgaggtcgcctgtgagaaataaaaatggaatcctaagccccccaactgaatggaccctctattggccaaggggaccccagattaaccttaaaaattgagttctcagccatgacaggatgagaggtcagacatgcctcagtatatccctccctcgctaaccatgttaggctttcctccctaagggataaacagaaactagctctttggaaagactccacttttgataccaacaaaccacctgatgctgcccctcctttttttgcctgagaaaagaccactgaccatgcagtggttctggccagtctatggagaatgtgcagtaaaggcttttgtgtcctctgcttcaccttttgacatcagagagctcaaaactccacccttggatcatgctaatgctaccattttttttgtacatgggacccacaaatgggcatgaagttcaattgcacaggaccacgtttctcctttcatgaatattcatgactcctcctatagcttattaaatatgtatatttggccaccttgctcagcgcacgttcctattccctttacctctcccttgaagtgtctgtttctagcttctggcaagaggctatgcttcctagcctgtgggaatgggcaccctgcaggctgcaacactttatgagaaataaagctgttttcccaaatttatgaatcttgtcattcttcagttgatacttgtctccctctctgcttctcattactgctcaattctccactctgtagctggaggggtcttcttaaagcataactacgatcatgtgaaacccccaccctaaggccctctcctggcttccccattgctcttagcatacacatccaagttgttaaacatggctgtttaataatcatgcttattatctgtgctggagccacactgactttatatcaggtcccctctttgcataggctgctattgtttcctccaataagctctccaaataaataagccttgcataatactgcttaaaaccaaagttaagtcctgaactctgaactaggaaggtctctttttagttcaggatactgtatgtcactgatataaagcactgtgtggagacaagtctcagagaaaaagacgaggctggcagaatataagagaaagtgacggatggaggaactggatgcctaaaagcacttcatttcacttttctaaatgtgccctgtcaaaatgaagggagcagacccagtaaggctgaagttagtggttgcacaataaagtagaatatttatcttcgctctggagctgcagaccattagcattagaaaacaccaccaagtctgtctcctaacatgcctggggccctcggaatggggaggatcctgatttaatgagcaagttacaccatctgtcaacaggacggctgagaggtaattcagccaacagcagctcccagaatttaaggagcaaaacacttgtgtgctatttgtgtaagacatggcccctagcttcacggtcaaggaatcctacgcaccctaactactcaagctgggagtgaggggtggtatctgtgtgtcttgctcacagtccagccagcttcagcttttttgtgtgggtgcttgatgagctttgcagaagggagacatccagctagaaatagggtcctggagagttccctctgcccccctttctgagcctaataatttctggcaagaggctacaacacgtattaacataaacaatatcactggccaaagtattcacactgttatggatggaaggaaggaggtgacagaagagagtatatttcatgtatattccttgtgagacacgattttgaaatggaaataatctaagagaataaattttgcacctagattagtgaaagcaacatggagttgctttggaaaatacctcagttgtaaaataatgtgatcttttactaaatgaactggtaattaatatcaaaatgaggaattttttccctgtaaaaattagtcaacttggaaatctatataaattcttcttctgtatttctatagctcattttataatacttattaaattttgaagtttacggatgtggggattttttttttttcacacacacttgtgagtccctaggccagagcttggcacacagggaggtagggtggcaaaagtgtatggacccaaaagtcaaataacaggaaattcaaatcccagctctcttacctagcagtatgaatttggtcatatttcctaagcctcagcttcctcatctgcagaatggggagaacaactatccatttctccagggttgatgtgacaattaaatgaaataaataatataaaatattactattatctgtaacacacaggaatcactcaataaatattgactactgttagatattcaagtgaaaatattcatttcagcataatgcttttatgcataaattgttgtgaaatcatcttgacatcctaactcccattgttcaaaacaaacaatataaatttgggtaggatttgatatgaagagacaactgaaaatcagttaaatataagcctggtatctatgaacttcttgactgtcagctttgagtcttactctcttattctcctttgaagctataatatctttcacagtgcttggcactcagctccagaagctataatatctttcacagtgcttggcactcagctccagtaaatatttatttaataaatggaacatttgttgaataaatcacggggtgaataaagtgggtgaacaatctgaacaatcacaagcaattttacttagcttgtttacccaacctagctttaggaatctattagaatgctatcaaaaagtagagagcactggatgcgggaaatattaataatttttctagctttccttcaccacagctgtggtggacatttgtcatgctccctggactgtcatcacattctgaatacctatcctatgtgcatcagtttcccattgctgctgtaacaaattactacacatttagtagcttaaaacaacacaaatgtattatcttacagttctggagctcagaaatctgaaatgaatcttaaggggctaaaatcaaggtgtcagcaggcatgtgttctttcttgaggctccagggaagaattaatttccttgtcttttccagctactggggatcttttgcatttctggtaactcccttccttcctcttcaaagcacatcaatccaacctcagcttctgttctcacatcttctttttctgactctgatcattctgcccctcttttataatgacttttgtgattacatttggcccacccagataatctaggataatctcccaatctcaagatctttaatcatgaatgctaaatcccttttaccatgtaaaataaacatattcataggttcctggcattagaattaggacacaaacatctttgggaggctattcttcagccaactcactatatttggagtatttcctgccttttgtatccagtcccacccaggtagaaacctgtactttactttggacaggatgcaggcatgtgactgaacttagtcattcagatgcctgagattatggttctaaagtgaacagcatgagcaagcaggtttgatatcaaatccatcttctggtgaggttggtagcagcagtgtccagctttctggataccaatggtgtatagagctcagtccacaccagtgatgagatctggctgtttctacacagcagtggcaggagtctttttttagagcaatgccataatatacccttgtaagtacaatttccaattactattttttggcctaccctcagactctgtgagcacctcaagtgctttaataaaaaattttttctgcttatagtagtcctgaaggtttcattatttataactaaggaacccagtggacacagcctcctgtgctaggttgtaagaagcgcttgcagggaggctgacggagtgctcctagaaaattggaacagcagacaatcatttggggcaccatttaggtgccaagtacttagtaaaaaaggccctgaagaaatggaatgcaatcattcaaactaggagttggtaaattgcgctgttctttataatacccggtgtagggggaggagagaaagagaatatcctatggaggtctgttctgagactttgatcttcatctcttctcaatatgacagaccaattcagatagaattctgtttgtgaaggaacagcaagagagattttgattactgattctggtcagcatggatgcacccctcagtgattttcaaagcactttatggcctttagttgtttacattaaattaaatagtcttggatatccattagtttagaaagcaaaattatatctggcttaaaactgctttttgcctactgcctcattcgcctctgcattatctagaacttgctcacatatggctcttactttatccatctgtaagacaaggtgatttttttttttttttcgaaataatgcatttccatccctctctgttcggtgtcttttgcttgcagtttggagagcttggttcaaatcctaactctagcagttagtagctgggtgacttgaactagttacttaacctctctgagcttcctttttctacaaaatgttgataatatactcccaaacagacttgtagtgaagattgaataagtatgtgatatggtggctgagctcagactctggattcagacaggtccacattcaaatcttagcttacatcttaacagctgtgtgctcctcagtgttacctgggtgcctgtctcctctcaatagaatcagagatggataagaagtccctcatagggttagagataaaatgagataataaatggacagcactttgcacagtgcctgttaggttctaatattatgaacagttaagtggctgtttggagtgggtgtttggagtgaattaaggaattatcaaacgaaagaataaaatcaacttcatgttttcaaacacccccaccaccaccttctctcaacacggtctctagtgatctgaaatcctttctaaataattgtttaaaagttgttaccactaacagagatcagatctgtggttgcctgcacaaggattggagagggactgactacaaagaaacatacagaaatttggggagtgataaaaatgttccacatcttagttgcggtggtggttataggactgtcttttttaccccaaactcatcaaaccatataattaaaatgagtgcattttatgtttaatgtacttcaataaaagtttatattaattaatgtattatgcttctagagcaagggttagcaaacatttttctgggaagggacagatagaaagtaatttgagctttgccggccttaggctctgttgcagctactcaactttgcccctacggtgtaaatgtagccatcgaaaatagatactagacagtacataaatgaatgagtgtggttgttttcaatcaaacacaattcatgaaccaaaatttgttttcatataattttcatgtgtcatgaaatatattatttcctcttttgatttttttccccaactatctgaaaatgtaacaaccattcttagcccctgggccttacaaagacaaggcagtaggctggatttggtcagtgggccactgtttgtcagcccctgctctagagttccaaagaggctttgttacgcagcgttatgaaatctgctttagggacttagtgcaaataccatgtctaagaggactgggagtccagctcctgtgagccctgtagggtctttgccagaacccactctctctgtggccagcctaagccgctgcttcttgacttcaattttgccatctgtgcagagaggacaacaatcatctctcagagcctggtaaagctcattcagcttgttatttgagagaaaatgctctaccaagtgcagaagctgatcatggcctgggttatgagtctggcctgtctcaatcatcagggggaaagtttgatttctcaggttgtcattcctaaaattgcttgttctccaggtgatgttcttatttctgaatatggtctgaccttcattccccaaagagaagggttatgttttcaaagagctggcagaagaagagtactcagaaagcttgctccttccctgccgaactgccatcccagcacaaaccatgccttaggggagggtgactttcccccataatgtttacctggatgggaccagagctactctaagctcctctgagagcaaagggagctttataaatgcaaaccagcacaaactgaggtttcttgtttttggtttctgacagtagaaggtgcttgaagcattactttggggtagtaaaatggccaaggtatccacaaaagtcaagacagttctgaggttcttgaagcttccgagcttttaaaaattgactattacatgtaaaattcaatcaatcccttactgaagaaaaaatcattattcaggtacccagtttatcctcctacctgttggaagcatttgattcaactgtttctcagaaatgtttttttgtaaagaggcagagaatacatgttttaggctttgcaggcagtatggtctctgttgcaactactcaatgctgctgctgtgatgtaaaagaagccctagacaatacatcaatgaatgagcatgactgtgtcccagtacaactttgttttctaagttgtaaacaaacaggttgtgggctggatttagtccacaggctgttgtttgctgagctctggtctgagttgtgttatatctagaagggacttggtggtttagggaagagaaaaaaacctaaatcagcagagactactggtgagaatgtggaaaaacctatcattacggattggagagtaaaacccaaccaatgagcatgttgcattaggagtaggatggggataccctagatgaatcctggccatggtgaattttcctgatgaaagtagaaaggcagccagtggatgggcagcaccggggacaagaagagccgatggggcattatggggagatactgctgctggctggactgctcataacagtgttcacaaagaagcctctggttgaacatgtgagaacctatgagtaagccatgtaggattcaggtgggtcaaaataaggtaaaaaccacagcatgagcaaaagcacaggtaagtgtctgcaaggtgccttcacagaatcctgagttggaaattggagcaaagttggaaaggtcagtctatggcacatcatggaagactttaaaacatcactttcaacagtgtgaactcttcatttttaagagtcagtgacaggtactgaaggtttctgagcttgtagtaccatatcccctacaaagcagctaactcaaatagtcttcctcctttacaaagagactatggttggctgcatctcacatgttatgaatttgatgctaataccagatcacatttattaagccattattatgtgcctgataatactgtactaaatgctttactttcatatgtcatttaataatgcttataaaaaatcactgatggggttattttttttgaaaatacttggaaaatggtttaatgatgttttacaacagaaatgaactgtacagttatggtaagtttaatatatatataaaattacagcagacaaatgcatctacacaaaatctaccatttcattctgattcactgtcacctacacaatctttcccaagcctacaacccctgcaggcagccctaggagggggaatcatctaaagggcacattgagagagacagcaccgctcatattcctcacaacctcctcaggcctcaggagctgatggggttatttttatctccattttacagattagaaaactgagatccataagaagttaacttacccaaagccaaccagcttgtaagaggcagagtgtgggtttaaatgcagctcttaatcattctcaactcaagctatatggcatctcagtggatttaaacatatttctgcattttaatagttaaataaaatacttttaacatcatttctaaattgtttctccagtgttccctctcctcaaagatctccaatactataattacatttgtcatccttttatcttcctatgaattattttttaagatcaccagattaataataaaatatttgtaaatttaaattttgttcaaatttaatacaatcccagtgcactgctttagtattaaatcttgatttccatcaatgacatatctatccatctatgtatataattattttcacattatttgggctatattttaggaggatgttgctttaatgaacacaaaccatatatttatctgacatgaatttttggccacacacaataatgtgatataattttaaataagtaaaaaatgcttatataagtaaaagcttagaaagaaacaaaccagaatattaataatagttgtattatggttatgtgattataagtgatctgttttttctcttttttcccaattattttaaattggattatgttagtgttaaatttttaaaatataatcatgtgaaaaatgttctttttaaaaaaagagaggttataaaataatccagtgggaactaatcagcaactaatgaaataatgcccaaatgcaaaaagtgatgatgttccatgaaggttccatgtacttaaagctactggatctcattaaatcactgggacctaaaatcaggctggctggggtgggtctacactcagcttctctaagtacaatcaatttaagagaaacaggagtaggggtttagtggattagtcacagcaggccattaatctctgcattctcagttgtaatccagcctctaccaacgagcttggaggaaaaaaatcccacaaaaaaaccaaacactgggaaaagctctaaagcaggctccctagagacagacatactcaggtcacagtttgcttgtctttacttaacatcaatacagtatttatcatctgtcctatttcttgttggtttcccttttatgccttttgctgaaatgctcagatcagatatatttgaaaaggaaccatactgcaatctcaggaatagctcagcatttaattatcatttaaagaaatccttctctcaagtgaatatgaaacaaatcaaagctatgttttcatgttgagaataggttgaaaaaaacatgggtaaggttaccacaaacacaaattagtgcttggggaagcaggtaagtctgaacaatgaaaagggaatagagtagccaaatttcagtaaaaatgagtgacagtttcaaaaattgcagggtaaatagtgtatcttttatcataaatggattaggccataataatacctcacttctttattgctctggcaaatgatctagaatttactaatgtattaagtgggaaaaaataataagcaaattcctgagccagggttctatttatgccactactgtcaaggccgaatatttattggattatatgagaccatatgcctacattagaggttttgataaatttaaagtgcagttgtaaactaaaaatatggggcattaatttcttaatttttaaaaaattattaaaggaacatatgggcaagacccagtaaactgtctctgaagatgatgctatgaaaagacatgattatctcccttcttattacctttaaaatattccccaaacattctagtttcccctagtgaatcagattcaaccaaccttaactgattatgtgctatgtgcagacattgtgctgaacactttcacatgcattggctcatttaatccccatgttttacatgatattgccaaattccttcctaattttgctcaacgtgtcttttattcttttagcttcagccatatcgaaagcaaaagccaccatttatcaagtgcattctatatgccaaacaccaggctccattttttttatttcaagcccgcttaactccaaaaataggtgttattgcctccaatttacaaatgaggatactgacacttagttagagatattaaataacttcctaaagtcacacaataagaaacatcagagttgaggttaaatagtaagataaggtataacgtataatgttttcgatgaatgctcttcaatacatctgtagcagtcaatgacgacccctagactctttcccagcgttgcactagagggtgacaaggtaatcattccacaaatgttatttgggttatttttctcataatgccttatcatatgattgcccatatagaaagtcattttccactttttgttcactcacagtcgtgaaagatcttcctatattttcatcttgttgcctcaacatttcaaaaactggggaagtttagcatgaacagcaaatttggacaactttctgtaaaagtctcttaatatactaaagttcctaagttggaaagggatctagaaactacttagtccaatatgcttaaactgtttaaaaggagaaaactggccccagaatagtaaaattaattcctccatgccacagaagtagtagtggcaaaactaacactaaacacaacatgtcctaacttccatcctagtaatctcttgagcaaatcacctaattctatcttccctataatgtataaaaatgtgctccaagaacaatacttaagaaggcttaaaattctagacctagaaaaggtatttgtttatcttaaccacagtttcctgtctctgatctaacttgttatgcaaaataacatcttgaatcccatagctatttaggtttgtttaatagattttgaggtaaaccattgctgaaaggatgtttgaaagattagtcactattctacatacttgcttactctctcaaggaattcaagcacattactagagcctcataaacaggttatacattactttcagatataatacagtaaaatggtaaggaacttcatactgtttgacccaataatcacaatattgagattatttttaaaaaaaattcgataaatatctacttggataaaaacaaatgccaaaaaatgtcataaactagaaacaacatatatgcttaaaaacaagggaaagttaaatataaataatgctattttacatgaataaactactatggaaatataagaaaaaaataatgcatattgaagtagcagatactagctaattgttcgcaaaccattttccctttgctcctggctacaaggctagcctacaactctctaactgctttaaaataagatgttaacaggtgcaacacaccaacatggcacatgtatacatatgtaacaaacctgcatgttgtgcacatgtaccctagaacttaaagtatgataataaaaaaaaaataagatgtggctggctgggcactttggttcacgcctgtaatcccaccactttgggaggccaaggcaggaggatcacttgaggttgggagttttagaccagcctgaccaatgtggtgaaacaccatggtaaaaaaataaaaataggccgggcgcggtggctcacgcctgtaatcccagcactttgggaggctgaggcgggcggatcatgaggtcaggagatagagaccatcctggctaacacagtgaaaccccgcctctactaaaaatacaaaaaatcagccggccgtggtggcgggcgcctgtagtcccagctactcgggaggctgaggcaggagaatggcgtgaacccaggaggcggagcttgcagtgagccgagatcccaccgacagagcgagactccgtctcaaaataaataaataaataaataaataaatataaaaaaataaaaataaaaataagatgtggcaatgtgactgaccagaaaggatgcccacagcttttcttcttggcccacaaaaacccctcccatggtcttcctctacactttttttccccatctggtgatgttgatgcccaggaaaactttggaaaccataggaggtagcacagcccccatcaaccttgtgactcccaagtcaccactaaatacagaattttttttcttttatctctttcctctcaccaagcacctacatgcccacacacatacattgacatctattggacaattaatgcaaagaagtaagcctccattgtgttatgtcactgagattgtggggtgtatgtgtcagggtccaggatatgctgaactgacacaactaggaagcaacatggagaaatatttaagatataaagtttctttttacagtacaaattggaaaagttacagtttcaaaatttagtaaacaaaaatttggtctatggggaataatttttttcctaatttttttcataatattttatcatatttggcataaaatacactctgattccaggcttcactcatgtctgtgacactaaaacactttgcatatacagtccctgtcttgcaaggagcactgatcaagaaagaacatctgagttggatacgtaattggcctaaacaaccaaggcataaacacaactctcattcatgaagttgttcaacttgtctttggatgtggcacattatatgcctttacctggcttagtcaagctctaatttaagcagttctaaaagcagatttaaaaaaaaaaaaaaagcctgcactaacttatacacttaaaattgcatgtggctctcattcaaccaataaaactcagtgctaaaacaaactaaaaggccacaaggaacttcaccacagtagaaaaacaggaatgaaacttgttacagaaataaaacataatgacttcactactttatattccactctacaggggtttgagtcactgtaacttaagagccagtatcattatggtgcattacaagacttagacatcaagtgacatatttctatcacacccaggtcatacaatagaaacttgatactcaccgatgtctcactttaaaatccccaaacatccactgagaaattaacaatagggccccttttttttctataacccctttttatttttttctgtaattaagattacaagcaaacaacaacaaattatccaattgaccatctcctcacagttgtaaagattaaccaggtgattacagggtgaattcacagccaaggacagcaaatccactctgttctttcaattcctaggctgccagctcttctctggtaagaactagtcagctacaccacaattctgttacaaaaggccagaggggaagtaatgttttctgacacaagactgaaaacaccatagagaccacagtaatttcctgtattgctctgcatcaagactaaaaagtggggtaggctattctccctaaagcactctagttcaacacactaacaagggaacagtgagctttctaaagtgttgttttctcccaagtaggaacttggtaagaaatagcgtacatgttccaaacaatctcctcaagtaggaacagagatgacatggagaaaagaatgacaatgtatccactgatctttaattgtcctagttcaagcctttggtatggtgtcataaatacaaaagggccgaaatacattttaaacaactataagtgccccaaataaggatgatttgtcaaatggaaatatgagtcagagcaggactagaaaactatcaaacatattgctcattgggaaggttcccattctctgtgactctgcacactcaaaaacctacatgcagtagaagcaagacaacagctggtagaggtgtcttcttcatctcccctccctcatggcctcagatcttgtccctcagtctgccctgaatgcagaaaagccactctccatcgctccttattattcatttatgtattaattcagtcattcattattgagcattttctaaatgccaggcactgggttgggtaatgggaaaaaaaacactcacacatttgtgtgtcactacacacattttatagggcaaagaccattgctgttttttttactacattttatcttatgcctggcccagtgcccacctcataggaggcatttgttagcatttgtgcaataaattaacaaatacatttaacactgggaaaaaaatcttccatatatattactttattgtttatttcaagaatcctctgaggtatttattattattctaaccttgtgttggaggacaggcctatgctccctcaataattgcagctatcagaattgttttccttgaggctaaaaggtagctgtgtgtgtagtgagagagaggggagcggaaagagaatatgttgactcacatccttcagtaaatctgtttattccaactctggcattgctgccaaatgtgttgcaaagccagcaagacttggctctggaaaactcacctgaaagtcacaggcctcatttcctactgccagccccttcagccaccaggcatgaagtattggacaaagttaaagattaattcttcatttactgtgacaaaattaccacttctcccagatcagtaggcaaaggcatttgtatgctgtgtccttcataacctttgataatctctccactgccatcctgatggcccagtaatgcaaatgtaatcaaaccccacactggctatcccgttaccagcccaatcttgctaataaacagcaattgtggctttgttataaaagtgatcctagatcatttgtcaccacccaaaccttcccaccccaacccctgactgctggaaatcctttaaaggtctgtttaaggttacatgaaataaaaactgcaaaaaagttacagaaaaccttcactaatcaatgagtaagatgataatagatataccgtaaaatccatggtcaacagggtcctggcttttttttcctagggtgtaaatatgtgacaataaactaagtaacaagatgatataaactctgtaatctatatctgggttattccaaagcttctgggaagccatctggaaccagggacaacagtggaaaatgatcagtggtctgggccaagtagagcatagctgaacaagagccaaagctttaatactgactggtctcttcctaatgaaggatgcaaactgcatacttccttgggcctttaaaagatgcctttcatgcacagagggaaaatgggtgatttttactgacattattatatgcaagggattactgttattgaaattatataccttaaatactcttccatctcaacctcatccatcacactacactctttagttgtgactatgttcactttttgaccgtctcctgaattaatcatgtcctatgtctcatctaatctcccttcctttgcaaatgctgtttcatatgatcatccatctctcatcacaaccctcttggttaagtagccaaaatcttccacgacaactctttaacatccttggagactcaccctaagcatcctctattaacgctacttactctccttctctacccctcctactttcaggatgagtcagatgtcccttctctcttctcctcaaacactttctatacctttttattacaatgcctatcacattctgctgtgactaccaatattttaaaaatcagtcttttactagatgaagaatttttggaggaaaaggtcactgtcttacttattctggttggattctgagtacctgatgtataatgtatcctcaataaatgttgaatgattaagtggacaatgaaaaccatttcatttaggtctctacactcattttatagtaactgaaccatagagtgggtaaaatggatatatcatttagttaaccatgggtatattctgttaagtgaatgtgtactctattggaaataagagttgaacagaatgtagtaagataaaactgctacacaatgctttgtagtactttgagcatctgttttatgtcaaatagtgtatctattgcttaacccataattaatcttcatgacaccaatgcatgtacagatgattcatttctcttagccttcatctaatgctaaagacattgttattattattcaagtacaaaattgaagatatttgtatttgcttaacctgaaaataccaaatctcaaagatcaggataaatgagggtcacgagagatttataaaaaatgaatttttaaaaaagtgtatcacttagaatgtcccataatgggcaaattgatctattaggtcaggattttttttaatgtgttttgtgatcaagaataaatgttgacagaaaaagaagacaaggagttgggtttctaagtaatttcttattacaatcaaagtaaaaatattaagttgcacacaaacctgattacgtcattttccttagctccccattagctagctcctcataaataaaaggtaaggtctaatcttattgtggtttacaatccccttcacactggcctaaggttatttttgtaacccctatatccagtcgtttagtctaacctatccactccatatgcccaatccaccatactttgatattttgttttttaaatatcttcttgtctatgaacatactattcttgccacatgatatgtcttctttctccctgttcttttgaaatctcatgtgttcttctaggtctaggtcaaatgttttctataaacattttcccttctccacttgtatctacaaacgacagagttaattgctcttcctttatacttccagtatactttatacacatttctattttacaacatgtactctcttgttaaatactaaggaccaaatattgttcatttctgtgattccagtgcctggcatagagtttgctgtcgatacgtctttgttgaacatagaataaatgattaaataattaattggcatttacaaaaactgatccaaagtgtcaacaagtattgttattgatgtcagtgatgatgatgatgataattttatgggagcaacttcaatttactgaatgattaatacatgtcaggcagtatggcagattcttatgtacattttctatacctcacattttacagatgaggagttaaggcacacagaacttaaattacttatccaagaccaaacagagagtgaatcccaaagttagaattcacacgtctgcctatctgggctccaaaacccaggcttactctcatatgatgtgtatgcattggccaatggctactgtattccagataccacattagccattttacaaatggtgtttttttatccttataattaccttgtagaaacaacaaccttgagaggtaattatcatctctgttttacagatgagcaagctgagaccctacctccagccccctccagttcaccccctacgaaaaaattccaactcaactgtctacaatctcaaacaggctacaaactatataaagtacagtgctagttgtagacatgcaacagaaatttaaaatccaaagaaatgttagaatttcaaacaaattttaacaaagaatccattgaaccgttgcaaagatccttaatacaaaaacgaaagtcacaaagtgaataaccatattaggacacttcatattctctcaattcaatagctccctaagtgggctcatcccaactttccagtatctcccaaagtgaattttttgtttcagttgggacattctttagcgtacatcctcttgtttctattcctcctttttgatgatgaggtcccctctgtctctttcatccaaacctccaaaatcaatctaatatactccttttctttcatgtctaaacttctcccttctatacaatttatgccaattattaaacaattagacattattcctattcctttatatcacaatgcattttagcattacaactttgcatttataataatatcttaacaaataaacattactcatattactttatatcattctaaactatgtgtatgtatctcaactttgcttctataactatatcttaagtatggatcatatatagtaatgacacagatgctttacacttgcataatgcaaaaaatatttattcaagaatcactctctgaagtttccctcagcaatgctttgaaataggcaaagcaaatataatttttattttacagatgaggattgagattctgagaggtaaagaaaactgcccaaatttataaaggtaatgaaggtagagtcacgttgaaggataggtcttctgatttccatactctttctataatggcttgctatcatacacatttatgatacctagatctctttttgaccttagtcccaagtatgtaatgcttaattaaggtgataaactgagacattagttactgacttaggctagtaatcaaacccctctccccagccaagggactgggtattcacatcaacatttattttttcccttgggatttcatacaactccaaaagactttcttgactcactatctggagagttttatctatgatgatggttatctgtcagtaactgggctatatgacatcacatgggaaactggatttaaagaaaccacattgctaatgagatcatcagataaatagtcattgtaagggtggggctttttatttgatgggacattctatttcaagccatattgaaagcatatgtcgtttgccagtgttgaggcactttaaagttgggtctatactgcattgtaatatacaactgaaagaaaaattcgctgatcccctgggtaataagtactacatggtttccaggtagtttagtaaactttccaagcctcaactccatattggactcatagggataaagtgggttacagttatgactatgcaccaaagcttaatgctaccagtctcatttgtatgagaaggaaaattaagagacttttcaaaattatttagccaaggcttcctggaaaatagggtttgtgctcaatgttatagatgtgcttgctgatgatggttttctttttgcttttaaacaagttgatatggaaaaaggtaaaagctctactccaccatgaaccaagcctatacaatgtcagatttgtaggaaataatgacattattgcatgcttactatgtggtagaaactgtgctgtgtgaaaatcattggacataatatctcatttagttgatagaacaaacatgtgacacgtgtactgttatctcttttctacacataaggaaactgaagttatgccattttaatgttaagattaggaaaacagtgtaggaaatattccttgcttgtagagattgctgatcctaagatgctagaggcatttgggtaatagcctcatctgtttgattgacagggtaatgtacaactcaaatgctaccttaattctagctctaaattgtaatcatctaaaacttttacttccaaattctctaagacttcaattcatttaacctaatttattctttcagagacatcaaaataaaaaatattaaataaaaatatttgaaaggaatcttgaaccaaaacataaatgatatactgaattttgactcaggtagacctggatgtgaaacctctagtctgaagctctgtgggctttggttgctatatctataagattatcccacaaattctaagaatagatgaattaaatatgtgcaatatatgtacaatgtgtgaaaataccacataattcaaatggttattgatgttattattatgaataaactgacaaagaagtaaagttacataaggaggaagtaggatgcattgtaaaaattaaatcaggcagctctcgtttgaccaagaaatttctctcctcgtgctgctaagcatacattcttgctgatctgagctgctttggtaggaagggaatggtgctcttgcagtacacggaaaaatcattctggttctctctctctccctctctctttctgtctctgatctcttcacagaccctggatgccttacattttcagaaaagtgagatctgagtttaacggaaagccagaggaactcccaaatcatgccctttagcctagctatgttgcattaagtagccaaagctgatgtgatctcacaaataaaagacatacatgctactgacccagcatctagctaagcctggccaaacagtctcattttccaacagtttcatcaaaaccaaattattagtgcagaaccaccaaatatgccaagcccaggtgtctgtactttaagcaatatatccaaataggcccaaggagaaatttgggggtgggttagaggaagtgttggaacctttggttaacaaaacactaagctacaaagcgccaatgttttcctgaaagcaaatgccaccaaatgaaattcagtcaatatatcttccacatgacaaagctactaccaacattttccttctgtaaagtgtttagactacagacttttactagccttttccagcctggtgtttctcaataatgaagccaactctatcaatgcttcaagtatcaatgtctggtaactctgtaaggattagcacccacttagtggtcaggaaaattcattccaagatgctaaagaggtgctttgtttttaatatttttaatttaagatttagtagattctatgatcacagggttatgttcctttcaatagagctcagtcatgagtaaattaaaactgcaaatcatggagacagaaatgaaagatccactaaactctctcaaagccacaaatattcaaccttagtgcattgcatttcctatacatcctaaggctgccagatggaaaaagaatggagtctgagtctcccaaactgtagcaattgtgagtcataatcatattactaataataattctcacatacatgggcattactgaatgagtggctctgcttacaggaggatgaggccaccctgaccatggagaagaaatggccttttaaagtttatggatgtgtaaaataaagagtatatgatgttgcatccctgcctaaatgtcttcataaagtgcaaattaatgcagatcctaactaggcatttggaacgctaacctagttttctgtgtttagctaatagctagcaattttgcttacacttttatcctctcattacatagcaataatgattatttagtaaatacatatgaaaggccatgtactccatagcactcctcctgagttggaaatccccctcctaatgcttccatttgaataatttagttgctgatacaccaaatcaaatatagctgtgacaggtatcccactaatgctttttttggaggctaagatcagaccctttctcagcctgttcccctcggtgattgcctggcgaaattcagggtaagggctggggacagagaggatgctggaggaaatccagagccttaatcaatgttaaccctttataaatcttaaaggtactcagatggcttgtctgatttgaaaattattaatgacactggggagaagtaaggaaaggctattttataactagtcaaatattctggaacaagagagagagtttgaaatagacatgtagaagagaaagatgtaaaatatggccttgtgagatgccacccacttcatatctggacatatgactgatataaacctttacaagtcacttgagaattttcactcctagatgcagaatggaataatagaagtcccactagaggagttggggtgaccccagggcacattttcttgtctgccaggtacacaacacatctcactgatgtatcacagagacaaatttcttaatagggtagccaagccccacacagaatgatttcggataagagtcccattccttccctatgaggagaaaattggaagccagactgggatttggaacagagtccagggtgagggcagaactagggttgttttctcctatccagaatcaggtctggcttaaagggaggggattgacagggctgaaggaagaggcaggaaacatgtctctccaccccagtgctgcttaaatgtggctgctcaaaggggcaatatcctgctctcctcttctgatgacttcatgggaagttggccgagtccccacttctgcagaagaatgcaggcagaagggagcactacaaatgggcttttccttgggtgcttaagtggcaggtgtgaagggaaatggggtgggtgccttcaatgggaggagccactgaactggggaatactgctggtccaggggctttcccctttccctcccagcttcctcccaaccccaattccctgcatcaacaaagacagtgctcaaaaaccagaactcgtcctaacacactcaggcacaggtgtccacaagcccaacctctttcacctcaacaccctgaaatcccgtttgctcttaaaagcacagacaggcccaagtagactgagaggtctgagccagcacatccttgctactgggaattaaaaaacaccgtgatgtaaagaaagtggtatttgtgacactgtagtgctttaacaagaaaattgggggggtagaggagggtgtgtcagcaggtttcaaagcatcacaatcagtcctgatgtgtttgggtaaggcatggaggacatatctctgatccctgctggtactctccagtcccgcatcctcccgcagtctcttgaaagtggttagatacccgggcagggccccgcgtccattttgccagccaggaaccaccgagtctgggaactttgaaagccaggggatgggggtggttgttgccaaggctcggatttcggcgccagagttctcagccaggaaagcagttgaaaatcaacacccatctgcctcttctttctcatcccccaccactttttccttcacccttctaggactgcacacagatcctaaccacccccccccgcaaaacacacacattcacacacccttgggctgagaagatttttgattctgaaggcggcaaacccgcagaactcaaagggtctcgccacccctctctctgccccgcggctatatacaataaaaccccatacaccccagacatcacaacataatccaaatcagccagtgacttcggcgcgtcccgtacctgatatgcagacgatgaaattggcttgaagaagaaaaagcacctcccagactatttccatcctctgattctcattccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatgtgcgccccagatgtgctgacacatgtccgatgcctcgctgccttggaggtctccccgctcgcgtgtctcttctcttcgcaccagcggcggaaaccgcactagcagcggcggcggcggcggcggcggcagcagccacctgaagccaccaacactgggctcttccagcaaaaacgagaccccgattcgtctggcgccccaagaagacatagacgatagccccccgccgggctgcgccgtgcaattccgggctcccgggagcgcgtagctcgctggctaagcccaggcagtccgcggcaagttgccctcgaagtccgcccccctcaccggggcatggtcggagggtggctgctgcgctccggggcagttcttctcctgcttccggggggcggggaaggagcagacacagcagacacacagagaaagagaggcagggattattgcccgaaaccgccagccgccggcagcctccgccgaccctccctgctccccaggtccgcgcgcagcctgcagcctctcagccgggttccggcagtgcgtccagggcgccgaggggaagggctgggccccggggactggggcgcggtgggggcacacagactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggcaggactcatcctgggagtgctgtgctgtgctctccctccgctgcgaaatattggagatttttttgcataattcattccctgccctctccatttcgtccctctcatgccccccaccctttacccctttccgtgccagtgccagaacactacttaccccagagttcttttctctgcaggttcctagaccaggtgcaactcttgcctgcaagtccctgcctccctcctcccgaaaagggggaacaccgcctttccaagtccgggtgccagcagcggctgctgccaactgcgccttcgcccaactccaggaggatccgggactattggaaacccgggctttagaggaacgggcttcccttcttgtctttcttttattctgcttttctttagggaagctctagtgctttggaggcttttgctgggctccaggatactttccgccaacgacactcagcagcttccactgaaggagatttccccaccaaacccgcgcgcgcacacacacacacacccagcgcgcggctctccagggccccaggggaaagtaggggcggcgcgagcaccacccacccacccaggccgaggccaggggcagccagtccgcagaaggtctcgtggggaggcgggctgtctataacctaggaaagacttgcacccggttgcagtgtggatgcaggggaattgaa
